United States Patent 7,745,391 (HUMAN THROMBOSPONDIN POLYPEPTIDE) - sequence listing, part 136

SEQ ID NO: 366231 - DNA, 5705 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagagggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366232 - DNA, 4303 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcaggtgagacccttctccctcaaaagtgtaaccagcaacccaccaacccacacccacgcctaaccattccagaatgttgccagagccctaactccccttctctctccacaagctgacctggattgcacttaagtttgcactctataagaagatgacccaggcggccatcctgatccagagcaagttccgaagggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 366233 - DNA, 3259 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcactccagcctgggcgacagagcaaaactctgtctcaaaaaaaaaaa

SEQ ID NO: 366234 - DNA, 3944 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtactgcttatattgatggagttatgggggctagaagtggagtaggaagggtgaggccgacttccatgaagcagaatcaaagtctggcttcagtttaggaagggcctatttacttcattttgggacaggcaaggtagccttttgcttagctccttttagaccatgtgacttggaagtcatgaggcagcggaggttgaaaattctggctggtcccacaatacagatgttggaaaaaaaaaatttggccgggcttggtggcttacgcctgtaatcccagcactttgggtggccagggcgggtggatcacttcaggccaggagtttgagaccagcctgggcaacatggcgaaaccccctctctacaagaaatacaaaaattaactgggcactgtggtatgtgcctgtaatcccagctgtttgagaggctgagacacaagaatcacttgaacccaggaggcacaggctgcagtgagccgagactgcaccactgcactccagcctgggtgacagactgagactgtctc

SEQ ID NO: 366235 - DNA, 394 bp, Homo sapiens
caatttcaggcatccactgagggtcttggaatgaacccctgtggataagggggactattagatagaataaacatcaataaatgcttgatgaataaacgctaatcctaccttcccagcctgacacctcccagtggacaccacacttcacttgaagccttagaaacctttcccacccatgcttccagccctggcttcatgttgccatttctcacccccagaacaggccgcccgcctgaagaaactacaagagcaagagaaacaacagaaagtggagtttcgtaaaagggtgagaacaactggagtgatcaaaggcagactcaggaaggacttccaataagttaaaattggaaggttgaggactcagttttgctgaaaatgtcttgagagaggtgac

SEQ ID NO: 366236 - DNA, 642 bp, Homo sapiens
agacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatggggtaggctaggcctggaggccaggggaggcagaggcgtttggggagagggagctacgtagagagggctgtcagccggagggtgggttgtcctgagggtgggaatctgggtgtctggcccagattctatcaggtcctaaccaacctggaggagagaataggttaggttcagttatcagatctgcccttccccttggaaaaatcaaacagagaagg

SEQ ID NO: 366237 - DNA, 351 bp, Homo sapiens
cttatattttggggaactttcatatcctgacttacaacactttgacttcttgacctccttaagctagtgtccttgactgcctcttcccaccggccctgtacagcttgcctcctagtgcctttacttctgatgttcctgctttgcccactttttccctcattgggctctgctgtctctctcccaaaccctccaggagtgtggagactggaagcttggacttagagcaggaggttgacccgctcaacgtggatcatttctcttgcacccctctggtgaggatgacggattcctgagcgcatatggggcagggagcaatgggaacagcccttgaaaaggaagatcctgaggaat

SEQ ID NO: 366238 - DNA, 889 bp, Homo sapiens
tgatcatcatgcctcactgccattccctgcctagggttcctgggggggccgaaggcatgcgatgccttctgtgaggtccatcttttgtttctttcaccagaggctcctttctcaccaagaagcaggaccaggcagcccggaagatcatgagattcctgcggcgctgccgacacaggatgagggaactgaagcagagaaagagaaacatatcagtattacaaaacaactatgaaaaaagtcaggaaactttcaaacagcttcaatctgatttctatgggagggaatctgaacttctagccaccaggcaagatcttaagtctgtagaagagaagctttctctagccacaggaggacttgatttcaaacagaaatcaattttgtggaaactcaaattaatctgattcacagaacctgaagactgccaaggctaacatgtggagcaggattcagcaagaaagaacagcaattgcaggagcgattgtaaagcactacaagactttccggaaagaaccaggtcctgaaagaaaaagaacctggtacactgagaaggaaataggtatccagtacaaggattggttctacagaaaaaaaatctggaaggccctggaaaggtattccaggccaaagaggctttaccaaggcaagaaggaaggaacgaaacaattccctggaaacaagattttgagaccctttaagttcagaaaccaaagattcccgctggggattgcattaccgcgaatccaaccgaccgttccgaacctccccacgtctcatgtgggacgagctttagtgacaggacttctaccggaagggcaactcatccacagtttgcttcttgaaacccccaagggtttagggagtcgaaggaggcgctattatggaaactgca

SEQ ID NO: 366239 - DNA, 5673 bp, Homo sapiens
agccggcgcagcggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366240 - DNA, 5727 bp, Homo sapiens
agccggcgcagcggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggaggaacagaggaagagttggggagcagactagccctccccccaccccagcctgtctcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366241 - DNA, 6038 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366242 - DNA, 5117 bp, Homo sapiens
taaagcaacatatctgagcagtcttgaggctgctggcctctgttcacctggccagaagtcttgaagcatgtcaggtgcttggaggagccatcaaggtactctggggcctgtttcgtggggatcccacagcacttccccctaacttctctagttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366243 - DNA, 6165 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366244 - DNA, 6097 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaagggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366245 - DNA, 6260 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtggtgaggccacagtgcggctgggggtggctgggagaggagcataggatgcggcaggagggcagtggaggctgaggtacggatttctaggcccgccctaccctcctctctgcccctagtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366246 - DNA, 1687 bp, Homo sapiens
ccgacaacctttttcccatccgtagccttaaattcccgagctgcccgggcggatcgtagtgttgattggagggatgagaatacccgccgggtccgattggccactgtctccgcctgcgttctcggagtagcttccctgcgggtgggctggagttcggcggccggcgtagggcgcggccctgcagggcggtgggagcctccccggggctgctcgtgttgcagcttgggatgatactggcggaacgcaggaccccaactcccaaacctgcggaccttgaccacggacgagccctgtcccagctccccacgtgccccagggggaccagagcaggcaggacgccttccaagtattcaagggccgctggttgcctacgcttcgtccccttgtttcttgaacaaccgttagggaccaggggtacccctcagggaggccacagtccggggctggggcgctcattgatgcagtgatcacacgtaagtttaataaccaacttgataagtgctctgagagaaaaataactgtgagagcggccacctgaggttctcccccaatctgcagtgagccgagatcagaacaggtaattccgtaaatgagagagagaagcaaagcgttacaggcagaagagtctatttgaaatctctgagaaaggaggaagcatgatgggaatggggaactggaattctctaatgctccgatgactgtctaagtgggggatcacccggcattgacagactgggaagcttaaatgagtcactcgcctgaggtcacatggttagtttgaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366247 - DNA, 6345 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtggtgaggccacagtgcggctgggggtggctgggagaggagcataggatgcggcaggagggcagtggaggctgaggtacggatttctaggcccgccctaccctcctctctgcccctagtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaaaaaaaaacaccaacacaaaaaagcaacaccgacaaacaaacaaaacgagaaaaaacacacgtgcacaaccaaaaaaacaacaacc

SEQ ID NO: 366248 - DNA, 4606 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 366249 - DNA, 4079 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcaggtgagacccttctccctcaaaagtgtaaccagcaacccaccaacccacacccacgcctaaccattccagaatgttgccagagccctaactccccttctctctccacaagctgacctggattgcacttaaggtattaggcatgagctctgagtgtgaggtctgtgatgattcagtctttccttgagtgtgtgggttacagagagtc

SEQ ID NO: 366250 - DNA, 2754 bp, Homo sapiens
  misc_feature (2709)..(2709): n is a, c, g, or t
  misc_feature (2716)..(2716): n is a, c, g, or t
  misc_feature (2720)..(2720): n is a, c, g, or t
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggagtgtggagactggaagcttggacttagagcaggaggttgacccgctcaacgtggatcatttctcttgcacccctctgntgtgggnttgngcctgggacactatggaagctctgagcttattat

SEQ ID NO: 366251 - DNA, 2303 bp, Homo sapiens
aagttctgaacttgtgaggcatctgggcctccccagaagacatttaacacagaaagcacagccctactaactagtattcttacctgtctcttcaagaatttcagaccaatcgaccgtcctgtctctttaaggcttaggaagagcagtgtggctgcccctttaaggaggcgttgcaacaaaccatattggacagacgatgggggcgacccatcgggacccgacgggcctctgactccagcaatacagcgaatcagcggctttcgggaatacatttttcggaaaaagacttcttcctcggttttctgctctgcacacgttgaaattttccccagtttttcctgcagatcgggagtcgagcaatgcctacccccgcgctcccgcaccagttgggcgctcccggatgatgccctacccctttggatccacgtggtctgcaacctggtgcgagcagcccgggctacagggttgcctgaggtgtgggtcccaggatggaggagccccaggccggcgatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggt

SEQ ID NO: 366252 - DNA, 3606 bp, Homo sapiens
gtggtaatggtatatatttttgtaaaaatttggttttttatttggaagatgatatagtagtagtgtgatgttttttttattatggttttagtttttgttgtttttttttttgtatgatgatttttgttttgggagtactggggtgtttggttttttttattttatttttttttcacagtgaaagaaacaagtttattggaaactactcctttacagagtagagtgtcctcagaaagcagggggagaaacccacagccctttgttagtatttctacttataagaaactataaggaactatagttaaacttggagtgtgcagataagctcactaaaggtaggggctattggtgttatccacgaccattaatcctgcaacctaagcttgctcatttatgttatatttaagtaatgggggctgcattcttaggacatttggacattctgcaggcttggtggaacatgttctgtatggccataaatattctgtaattataattggtggtcagcctgggatgtggttattttcaggccataagcatgaaccttgtaagtgcctagctactcactttaagatggagtcactctagtcatgttttattaaaaaccagaggccagccaggcgcagtggctggtgcctgtaatcccatcctttgggaggccgaggcgagcagatcacttgaggtcaggagttcaagaccagcctggccaacatagtgaaattgtctctactaaaaatacaaaaattggctgggcgtggtggcaggtgcctgtaatcccagctacttgagaggctgaggcaggagaatcgcttgaacccaggaggtggacattgcagtgagccgagatcatgccactgcactccagcctaggcaacagagcaagactctctcaaaaaaaaacaaaaaaaaaatcaaaaaaccttccctctcctgttccacttaagcctctgccctccctgtttctctctgtagcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcactt

SEQ ID NO: 366253 - DNA, 3754 bp, Homo sapiens
aagttctgaacttgtgaggcatctgggcctccccagaagacatttaacacagaaagcacagccctactaactagtattcttacctgtctcttcaagaatttcagaccaatcgaccgtcctgtctctttaaggcttaggaagagcagtgtggctgcccctttaaggaggcgttgcaacaaaccatattggacagacgatgggggcgacccatcgggacccgacgggcctctgactccagcaatacagcgaatcagcggctttcgggaatacatttttcggaaaaagacttcttcctcggttttctgctctgcacacgttgaaattttccccagtttttcctgcagatcgggagtcgagcaatgcctacccccgcgctcccgcaccagttgggcgctcccggatgatgccctacccctttggatccacgtggtctgcaacctggtgcgagcagcccgggctacagggttgcctgaggtgtgggtcccaggatggaggagccccaggccggcggtgagggtgcgggttgacggggtgcggagggtgcgttggtggaaggagaaaggggcgtccgagagggttcgggcggaaaaggaggcgtacctgcaagcaggacttgcgaagagcgtgcattcccagtgggcgaacgggaattcgaacggagagagggttatcttgtggggggctacccgtggagagcaaggcgcccccaggggttggatcggtgaaattgaggtcgcccctggggaacaggtgggcagaaaggagaaaccaggttgaggggactggagtgctcacgaggttaagaccaatggaccgataggcgcgccctgcaagattggaccggcaaggaggtgtcagtcgaccccatttccccttctgctgcagatgctgctcggttctcttgtccccccaactttaccgcgaagcccccagcctcagagtcccctcgtttctccttggaggcgctgacgggtccagatacggagctgtggcttattcaggcccctgcagactttgccccagaatggtgagtggtcttgttgacggaaaagagggtcccggtccagaccccaagagcgggttcttgaatttgtcacaggaaagaattagaggtgagtcacttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcactt

SEQ ID NO: 366254 - DNA, 3286 bp, Homo sapiens
aagttctgaacttgtgaggcatctgggcctccccagaagacatttaacacagaaagcacagccctactaactagtattcttacctgtctcttcaagaatttcagaccaatcgaccgtcctgtctctttaaggcttaggaagagcagtgtggctgcccctttaaggaggcgttgcaacaaaccatattggacagacgatgggggcgacccatcgggacccgacgggcctctgactccagcaatacagcgaatcagcggctttcgggaatacatttttcggaaaaagacttcttcctcggttttctgctctgcacacgttgaaattttccccagtttttcctgcagatcgggagtcgagcaatgcctacccccgcgctcccgcaccagttgggcgctcccggatgatgccctacccctttggatccacgtggtctgcaacctggtgcgagcagcccgggctacagggttgcctgaggtgtgggtcccaggatggaggagccccaggccggcgatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcactt

SEQ ID NO: 366255 - DNA, 3661 bp, Homo sapiens
aagttctgaacttgtgaggcatctgggcctccccagaagacatttaacacagaaagcacagccctactaactagtattcttacctgtctcttcaagaatttcagaccaatcgaccgtcctgtctctttaaggcttaggaagagcagtgtggctgcccctttaaggaggcgttgcaacaaaccatattggacagacgatgggggcgacccatcgggacccgacgggcctctgactccagcaatacagcgaatcagcggctttcgggaatacatttttcggaaaaagacttcttcctcggttttctgctctgcacacgttgaaattttccccagtttttcctgcagatcgggagtcgagcaatgcctacccccgcgctcccgcaccagttgggcgctcccggatgatgccctacccctttggatccacgtggtctgcaacctggtgcgagcagcccgggctacagggttgcctgaggtgtgggtcccaggatggaggagccccaggccggcggtgagggtgcgggttgacggggtgcggagggtgcgttggtggaaggagaaaggggcgtccgagagggttcgggcggaaaaggaggcgtacctgcaagcaggacttgcgaagagcgtgcattcccagtgggcgaacgggaattcgaacggagagagggttatcttgtggggggctacccgtggagagcaaggcgcccccaggggttggatcggtgaaattgaggtcgcccctggggaacaggtgggcagaaaggagaaaccaggttgaggggactggagtgctcacgaggttaagaccaatggaccgataggcgcgccctgcaagattggaccggcaaggaggtgtcagtcgaccccatttccccttctgctgcagatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcactt

SEQ ID NO: 366256 - DNA, 2961 bp, Homo sapiens
gtcaggtggaggatccctttccctcccgccctgcttttgctaggggaggggggtgccctgagcctgagtcgcagccagcctgggagctgggccatgttggccgcagatggccccctggtgaaggttcccgttggctttgggaagtagacaacgggtctgcctcacggggctgaggtgggactggaggatttcgagggcagaactctgggaaggaaagaaaggcttaggacccaaccagcattccccctggcactgcgggggcctggccagctcatggcgttccctgagcctgttccccaactgtgaaagggggtgatgatcttcacctcccggcatcctgagcggccaagcaggttgggggcgcctgccccccactaggccaagtggagggggtccctccgtccaatgggcctggccagggccctacgccgcctcagcggcgccctggattcgggagacagccgggcgggcgatgaagaggaggccgggcccgggttgtgccgcaacgggtgggcgccggcaccggtgcagtcacccgtgggccggcgccgcggtcgcttcgtcaagaaagacgggcactgcaacgtgcgtttcgtaaacctgggtggccagggcgcgcgctacctgagcgacctgttcaccacatgcgtggacgtgcgctggcgctggatgtgcctgctcttctcctgctccttcctcgcctcctggctgctcttcggcctggccttctggctcattgcctcgctgcacggcgacctggccgccccgccaccgcccgcgccctgcttctcacacgtggccagcttcctggccgccttcctcttcgcgctggagacgcagacgtccatcggctacggcgtgcgcagcgtcaccgaggagtgcccggccgctgtggccgccgtggtgctgcagtgcattgccggctgcgtgctcgacgccttcgtcgtgggtgctgtcatggccaagatggccaaacccaagaagcgcaacgagacgctggtcttcagcgagaacgccgtcgtggcgctgcgcgaccaccgcctctgcctcatgtggcgcgtcggcaacctgcgccgcagccacctggtcgaggcccacgtgcgtgcccagctgctgcagccccgtgtgaccccagagggtgagtacatcccgctggaccaccaggatgtggatgtgggctttgatggaggcaccgatcgtatcttcctcgtgtcccccatcaccatcgtccatgagatcgactctgccagtcctctgtatgagctaggacgtgccgagctggccagggctgactttgagctggtggtcattctcgaggggatggttgaggccacagccatgaccacacagtgtcgctcgtcctacctccctggtgaactgctctggggccatcgttttgagccagttctcttccagcgtggctcccagtatgaggtcgactatcgccacttccatcgcacttatgaggtcccagggacaccggtctgcagtgctaaggagctggatgaacgggcagagcaggcttcccacagcctcaagtctagtttccccggctctctgactgcattttgttatgagaatgaacttgctctgagctgctgccaggaggaagatgaggacgatgagactgaggaagggaatggggtggaaacagaagatggggctgctagcccccgagttctcacaccaaccctggcgctgaccctgcctccatgatgcaaactgatgtccccttccccgtgtatgcccccttccccaaggtagcaagatggagggatggggctctctcctgggatgggggcaggtgttcctgaataccgacaggcctgctgggtaaatgactaggtggtaaggttctgccatgcctggtgacccaccatggacatactggaccttaattcctctgcttctgtgctccctcctgagaaccctttatgagcctgattcctcagtctcaccagaattctggatcacccaagaggaaaagactggcagttctagattcctctatatggggagacctggattgttgaccagggtgagaagccaatggtatagactgcctctggggaagcaagttggcagttcttgaacagcatcagatatcaagagtttgtaggtctggattcacctaagattcaagggagtgttgcttctcaactcagccaactgagtagcaaatcatttgttctagaccacctaaggagggaaggttatggaatgccccaagtattcaagatcatcttgattgaccaaagaccaaaaaaaaaaaaaagacctgtggttccagaaagctcattagttgagattctgtgagtctaggttgaccacagaggcaagcactggtgagtctaggacagattttacgtggagagttgaactactccagaaactaaagagtaatgtttctagaatgcacaaaacattattagtctgtgggtttagaaagactgaagtgacagattaagagttcttgatattagataactccaacttctggctgtagagcacccagccaagagaataagcagtgctttgaaaggatccactgggtgggttgtttttttttaaagtgccattctagaatgtccaaagggaatcaggattctgtggctgtagactgatcacagagtcaaggaagcagtggcaattctagatatctgagattttgctggttccagtttgcccaatggagttgagaatctcaatgattctagatgacttcttgtggttctgtaatgccaaaaggaatgaaggctccagggatacagagttgtccattaccaaagcctggaagttctcatcacctccaggtggactgcttggcagtgctaggaggtggactcaggacttcagaagcaacatttctggcctgacctggaaggtgaaggtgaaggtgagaccctgtagggcacagggctaattagtggacaagggaagggggaggcccaggctcgtgcc

SEQ ID NO: 366257 - DNA, 3991 bp, Homo sapiens
tgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366258 - DNA, 2969 bp, Homo sapiens
  misc_feature (64)..(64): n is a, c, g, or t
  misc_feature (132)..(132): n is a, c, g, or t
  misc_feature (164)..(164): n is a, c, g, or t
  misc_feature (1960)..(1960): n is a, c, g, or t
atcatttaattatcataacccaattatgaagtagatatactattattccatattcagctaaaanaaaaaaacactgagaaaaagacagggtaagtaatttgcccagggtcacacacctgctaaaagacaganctgggattgcatcctaagcagtgagtgggtantgctgataacagctacaccagactgctgtagcactagataaaataaaaacaactgctgctctttgaatgcctactctgtgccagttactgtgtgctctaggtgttttacatgggttaccagttaatccttacatccttacaagttcagaagcaaataatgtttcagtcttacagatgaagctcagggaattgttctcagtaaagatcaagcgtatgaaacaaaaaattgtctttttcagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatggtaagtattattttcattgcttttgtggtaatatgaaaaatataaattcgtaaatgtttttatttatgtgcagtcaaatattacagaaagaaaaataataaggcatatatttctgtatatgaaagaaataatttcatgttttgatcaatatcaattagctggtataaagttatttgtatagagtactttcaaacaactaaaatatgtgactttaatagaaaatgctaacacttccagatcattaactatgtgccagtctctgtactctaaatacttaaatataccatttcagttaattgtcataacaaatcagtgagatggatatggtctcaacattttacagaggaatcagttgaggcttggagacaagttccttcaggtagtaaagtggcagagatgggaactgaattcagttcttatgctctggactcatccctggtgctgaactgcatactcagaagaatgtagaaatctttcataagtgtttggctacagactaaatcagattactgagttaacaaataataattccataaaaagagactatacacccctctgttgcaataacaacaaaagaaattgtgagtttgatgttaaattaatacaaatgactattttaaagtatcttaggaaaacccagcttataatttgtacaagagtcaacatttattgcaaacgttatttgtagaccattgttgtgtgagcatcactgccgatggctattgtttgactctgatagtggattccagtagagctcagcagatagttagtttcctgaaggctcacttacattgtggcaagatggcttaagtctagttgttgaacccaattgtatgaagtacagtttatcaatatatatagcatcttgcagaaagaggcaagattaaaattcaaggccatgacaggtgatcagtttagagagctgcatattcatgaggaatgtcaaaagtgtatttttaagagaattcaggggcatcaatattccagttagagattggttttaagatgaagatttagaaattgatatctgcatatgtttgaaattaagaaatgattataaatgcaatttaaaaaaataaaattcagtaggcaaagaactatgagtctgaagaatgtttatataaaagttaaggaagcttcctcttgtaatatattgacatagtaaatgctgaatgcatagttgcngaactgaacatccacaggaaatagccagtgtctctaccacaaggcagcagattggtaggtctgtgcttatatcagcatactggtatttccttgactttcatcaacaaaatgaaacaaagttaaaaaccaaatgtaagctactttctttttagaggcagctggcactttaaaacacatacatgaagaatacttacgttgtttgttgaataaatagatctaccataatatgccacataatgcatataggggatgggagtgtgaatgtaaataatgaattttttgctttccttactcctgtgaaaaacattgaccataaacttttcctgacacttgaggtttatggtgaaacattctaactcacatgttctctggccaactcacagtgatgcattggctgttggcatcttcttgctgagaagcaaacattagcattttactctgtcttaacggaagaaatgtaagtcaaaatccttcatatcacctggatgccacgtgcagctggattggcctgtagaccactaaccagatttctgggctatctaagacgctgcattccctttgagaaatcaacatttggtagtttgttttaatgccggaacagtagtacttggatggaattttccatccactgaaggaacaaagtacattcttttctctcgcaacatagccttgaatcttgaaaagggatcaaactttcacaggaagttgtttgcataaaacatatactattgtctcttggtatccatggggaattggttccagaatactctataaattaacagatgctgaagtccctcatataaaatggcatggtatttgcatataacttgtacatatacccccatatattttaaatcatctctagattacttataacaccagctgggcacggtggctcacacctataatcccagcactttgggaggctgaagcgggaggattgcttgagtgcaggcgttcaagaccagcctgggcaacatagtgagaccctctctctatcaaaaaaaaa

SEQ ID NO: 366259 - DNA, 572 bp, Homo sapiens
atgttctcttcagaaaatctaactgtaaacttggtactttcctacagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgcctgtaatcccagccctttgagaggccaaggcaggtggatcacttgaggtcaggagttcaagaccagcctgggcaacatggtgaaaccccacatctactaaaaatacaaaaacagctgggcgtggtggcatggacctctaatcccagttacttaggaggctgaggcaggagaatagcttgaacccaggaggtggacgttgcagtgagccgagatcatgccactcgactccagcgtgggc

SEQ ID NO: 366260 - DNA, 1156 bp, Homo sapiens
attttatttttcatactaagtctagaaatctatttttttctagaatcttatatagaaaatatagaaatcttatatttacagcacatctcaatttggatgagccacattttaaatgctcaatagtatgtgtgtctggctgttgtactggacagcacaggtctagagaatcatgatgagcaaaggacaggagttctccctgttttccctgtgtgttaacctctctagcatctctccaatctaccccctttccacctccactgctctaattcagaacctgatcatctcccacccagacacttcaaaccacttcctatctagtgtccctcatctcacgaatgtattgtacatactgctgccacttaactctctcatttcattcttctgcaccttcactggatcacatttcctacagaaacccaaactcattatgatgataatttgtcccttttagaagaagcctgtgataatttacatgccagccataattgtatctctggtacatggcacatgtattccagtatggaacactttctagccctacccctatcctttaaggctcaggggacagttactatcactgtgaagcctttcccgtaacactctgcttaggtttcatttttgccacttaaaattgtatgtcttaggttttggggtttcggggtccatgcctctttccactctagatatcaggcactttcccatcatcctccatagcctcacacataatgggcattcaataatgtttgccaaaattgaaatagacaaaattgacccattttcaaataatgtttataaccaggggctgttactgttttgttttttttttctttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagaatgtgttttgaattcggttggtgtcaagttaaagcactaaggcaatggcctaaagggaactgtctgtgtggttttattttacaggggttgttttcaaga

SEQ ID NO: 366261 - DNA, 4013 bp, Homo sapiens
tgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatcttaaaaaaaagtcgacgcggccggc

SEQ ID NO: 366262 - DNA, 1850 bp, Homo sapiens
ccactttgacaaaatggctaatatccagaaatttaccaatacaacactttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366263 - DNA, 1965 bp, Homo sapiens
gtaccttctgggtgccgtctgagtgaaatttaggaatatgatgcttagacccttattatggtgcatgatcatgccctctgacacattgggttaatggacagagacgatctctaatgttagactcaacttgcttatccataccatgataactatgcaatagaatgggcccaaggtggaattttctttggctttccttgagaaattctacactaaagtttggacaaggtagcaatccagcccgtaagaattcaggacatctaaaaatgacgaattggcctgtctttttttctgtgtgtacaattctaatattctgaaggtaaatctggcccatataaccttttgctgtaggtaggcccatgttctccattagttagatcatcatatttagtcaagaggagaccattagcaaatgacttgaacagatttaaatgctattactcttgctgggtggtctgaagataatagcaacttgcttcttttttgtttgattatttgaagagatcagtgtctgagctaaaactcatgtccttttcattgttttgtgactgtagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366264 - DNA, 1440 bp, Homo sapiens
aagcagtgctatcaacgcagagtggtcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366265 - DNA, 1120 bp, Homo sapiens
attgtcttctgtcaattatgggaatgggtgccaataatttttagtgcattttccccacagttttggttttcaggtaatgaactacaccaatgttcaagtacatggttttatgtttttaacattatgataatctcatattgctacttctatctaaatgttataaactgtactaaaactttgattttcttaaatctaagacattgctgcctgaagtgggaaacccatactctcaacaactcagaatgataatgggtattatccaacaaaagaggccatattcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366266 - DNA, 1660 bp, Homo sapiens
attttatttttcatactaagtctagaaatctatttttttctagaatcttatatagaaaatatagaaatcttatatttacagcacatctcaatttggatgagccacattttaaatgctcaatagtatgtgtgtctggctgttgtactggacagcacaggtctagagaatcatgatgagcaaaggacaggagttctccctgttttccctgtgtgttaacctctctagcatctctccaatctaccccctttccacctccactgctctaattcagaacctgatcatctcccacccagacacttcaaaccacttcctatctagtgtccctcatctcacgaatgtattgtacatactgctgccacttaactctctcatttcattcttctgcaccttcactggatcacatttcctacagaaacccaaactcattatgatgataatttgtcccttttagaagaagcctgtgataatttacatgccagccataattgtatctctggtacatggcacatgtattccagtatggaacactttctagccctacccctatcctttaaggctcaggggacagttactatcactgtgaagcctttcccgtaacactctgcttaggtttcatttttgccacttaaaattgtatgtcttaggttttggggtttcggggtccatgcctctttccactctagatatcaggcactttcccatcatcctccatagcctcacacataatgggcattcaataatgtttgccaaaattgaaatagacaaaattgacccattttcaaataatgtttataaccaggggctgttactgttttgttttttttttcctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgctcaggtataaagccaattaaggtacaattgtaccataaagggaacaatctgtttctgattgcacagtttctaatttttaaaactgatgtggtttgcatttcataaaaggcaaagtttacagaaccataaacattctcaattttctttatgctagacatataaattatttttcaaactgtatagatttggggtaaaaagttgtctcagttcctctcccaattgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366267 - DNA, 3284 bp, Homo sapiens
tgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagcttattctaccagattccatgaaagtattgccagtgtacatgaattgcttgttgaaaaactgtgtactactcagcagaccagagatctcaactgatgaacgagcataccagagacagctggtcatgaccatgggtgtggctgactctcagcttttcttctacccacaacttctgcccatacacacgttagatgtcaagagtacaatgttacctgctgccgttcgttgctctgagtcccgtctttcagaagaaggaatattcttactggctaatggtctacacatgttcctgtggttgggagtaagcagcccaccagaactgatccaaggaatatttaatgtgccatcttttgcacatatcaacacagatatgacattgctgcctgaagtgggaaacccatactctcaacaactcagaatgataatgggtattatccaacaaaagaggccatattcaatgaaggtaagaaagcaattttatttttccctttattcaaatgttaaaaatttcattaaagacttaacatgcacaccctatatttttatgacgtgatctttgattttaaaaactcacaccatcacaaatcta

SEQ ID NO: 366268 - DNA, 636 bp, Homo sapiens
tgagagaccgtgttgcaatgaagctcacaattgtaaagcagcgagaacaaccagaaatggttttccgacagttcctggtagaagacaaaggactttacggaggctcttcttatgtggatttcctttgttgtgttcacaaggagatctgtcagctgcttaattaattgaaacttctctgtcattgatgttgcatttccaaggagataatctccttcttggtgcctaattttctagatgataataggctagttttgatttcttgctcattttcagaataactttccaggaagagatggcatttagaacttcagctttggtgttgcaatgagaaaaaaaagcttaatttttacattatacttaattttctaaaaccatgtaactccattgaacacatttttcaacttaaggtctgcatagcagacttttaataaccttgggatttatctggtagaacaatatgtgttctacatttttttcataattatatattgtgtatgttaaaactattttccagttgttttgtctgtaaaactgtctttatcaatatgcttaatggttctttgtacaattttgaaagtttctacctgtatataatggatgttaaccagtatcaataaatcacttcgtataatctta

SEQ ID NO: 366269 - DNA, 797 bp, Homo sapiens
gcggccgcctactactactaaattcgcggccgcgtcgacgggggtgtgaatgtaaataatgaattttttgctttccttactcctgtgaaaaacattgaccataaacttttcctgacacttgaggtttatggtgaaacattctaactcacatgttctctggccaactcacagtgatgcattggctgttggcatcttcttgctgagaagcaaacattagcattttactctgtcttaacggaagaaatgtaagtcaaaatccttcatatcacctggatgccacgtgcagctggattggcctgtagaccactaaccagatttctgggctatctaagacgctgcattccctttgagaaatcaacatttggtagtttgttttaatgccggaacagtagtacttggatggaattttccatccactgaaggaacaaagtacattcttttctctcgcaacatagccttgaatcttgaaaagggatcaaactttcacaggaagttgtttgcataaaacatatactattgtctcttggtatccatggggaattggttccagaatactctataaattaacagatgctgaagtccctcatataaaatggcatggtatttgcatataacttgtacatatacccccatatattttaaatcatctctagattacttataacaccagctgggcacggtggctcacacctataatcccagcactttgggaggctgaagcgggaggattgcttgagtgcaggcgttcaagaccagcctgggcaacatagtgagaccctctctctatcaaaaaaaaa

SEQ ID NO: 366270 - DNA, 3090 bp, Homo sapiens
tgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccaggtgagctacctatggcacatagatgttaaagtgttacaaacgactactcatttcttcagcacatagctatagaaggcttatgatgttgcaggcacttagatgctgttacagtaaacagtgtagctgagaagattaagaatgcaatttgggggggctgtggtttttttttttatagccaacatttaaaaatgtgaacaaaaaaaatggatgtgcatattcagttgaactacttttactgaattgctggagccaaaactaggctgcagcaagagaaggcaattagggtacaaaatctaaggaagctgtcattctgaggatcatatgatagatgctgggttaagacatatggctgggcatggtggctcatgccttaatcccaccctttgagggctca

SEQ ID NO: 366271 - DNA, 3008 bp, Homo sapiens
tgcaactccgagcgtgagtccaggctaaggggacgccggccggggaagaggcgcggcgggagaagcgaccgcagcgggagcccggccaccgagggctgccggcactaggcgcagagccgccagcgctcggaagcccgcggggtgcgggagcgggaacagacttcttttgtagaattatcctatggaatgatattttcataatgagtcaacaaggttacgtggctacacctccgtattctcagcctcagcctggaataggcctttctccacctcattatgggcactatggggatccgtcgcacacagcatctccaacaggtatgatgaagccagcagggcctttgggggccaccgccactaggggaatgttgcctccgggtcccccacctcctggaccccatcagtttggtcagaatggagctcatgccactggtcaccctccccaaagatttccaggccctccacctgtcaacaatgtggcatcctcacatgcaccataccaaccctctgcacaatcttcttatccaggtcctatatccacttcatctgtcacccagctgggcagccagctcagtgctatgcaaatcaacagctatggttcaggcatggctcctccaagccagggaccccctggccctctgtcagccacatcattgcagactcctccacgacctccacagccttccattttgcagcctggatctcaagttcttccaccaccacccaccacactcaatggtcctggtgcctcacctttgcctctaccaatgtacagaccagatgggctctctgggcctcctcctccaaatgcccagtaccagcccccacctcttccaggccagaccttgggtgctggatatcctccgcagcaggccaactctggtccccagatggcaggcgcacaactgtcttacccaggaggcttccctggaggtcctgcacagatggctggtccgccacagccccagaagaagctggatcctgactctatccctagcccaatccaggtgattgagaatgatagagccagcagaggaggacaagtttatgccaccaacaccagaggccagatccctcccctggtcactacagattgcatgatacaagaccaaggaaatgccagtcctcgattcatccgttgtacaacatactgttttccatgcacgtcagatatggctaagcaagctcagattccattagctgctgtcatcaagccctttgccaccattccttcaaatgagagtcccctttacttggtaaatcacggcgagagtggaccagtcagatgcaacaggtgcaaggcctacatgtgcccatttatgcagttcatcgaaggaggaaggagatatcagtgtggattttgcaactgtgtgaatgatgttccaccattctatttccaacatctggaccacattggaagaagactggaccactatgagaaaccagagttatctctaggatcttatgaatatgttgccactttggattattgcagaaagagtaagcctcccaacccaccagcctttatcttcatgattgatgtttcatatagtaacataaagaatggacttgtcaagctcatatgtgaagaactgaagaccatgctggaaaaaattccaaaggaagagcaagaagagacgtctgcaattcgagtgggttttatcacatataacaaagttctccatttctttaatgtgaagagtaatctggcccagcctcagatgatggtggtgactgatgttggagaagtctttgttcctttgttggatggtttccttgtcaactatcaagaatcccaatctgtgattcataatttgttggaccagattccagacatgtttgcagactctaatgaaaatgagactgtctttgctcctgtcatccaggctggcatggaagcactaaaggcagcagactgtcctgggaagctgttcatcttccattcttccttgccaactgctgaagcaccagggaagctcaaaaacagagatgacaaaaaactggttaatacagacaaagagaagatacttttccagccccaaacaaatgtctatgactcattggccaaggactgcgtggctcacggctgctctgtgacactcttcctctttcctagtcagtatgtggacgtggcctcgctggggctggttcctcagctcactggaggaaccctttacaaatacaacaatttccagatgcacttggatagacaacaatttttgaacgacctcagaaatgatattgaaaagaaaataggctttgatgctattatgagggttcgtaccagcacaggtttcagagccactgatttctttggtggaatcttgatgaacaacaccaccgatgtagaaatggctgccatcgattgtgacaaggcagtgaccgtggagttcaagcacgatgacaaactcagtgaagacagtggagccttaatccagtgtgctgtgctttacacgacaatcagtggtcaaagaagacttcggattcacaatcttggcttaaactgcagctctcagctagctgatctttataagagctgtgagacagatgctcttatcaacttctttgccaagtcagcttttaaagcagttctccaccagcctttgaaggtcatccgggaaattctagttaatcagactgcccatatgttggcatgttaccggaagaattgtgcaagtccttctgcagcaagccagttcacttgtgaaaaataatatctatgaagatggagagattcctaaaggaattccactattttaccatagagcccaaagtttccttgacccaagcaagaccatcaaggagctatctggattgtatgatactggacctcagtagaactacttttactgaattgctggagccaaaactaggctgcagcaagagaaggcaattagggtacaaaatctaaggaagctgtcattctgaggatcatatgatagatgctgggttaagacatatggctgggcatggtggctcatgccttaatcccaccctttgagggctca

SEQ ID NO: 366272 - DNA, 2462 bp, Homo sapiens
cccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366273 - DNA, 707 bp, Homo sapiens
  misc_feature (37)..(37): n is a, c, g, or t
gctagtgggcgggtgttgaatcggacgaggcagatancaggacccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366274 - DNA, 312 bp, Homo sapiens
cacactagaacggcgctgttgtataaccacccactgctgccggtgacatgcgtgaggggccagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366275 - DNA, 1642 bp, Homo sapiens
tcctgaggctgggattacaggtgcccaccacaacacccggctaatttttgtatttttagtagagatggggtttcaccatgttggccaggctggtcttgaactcttgacctcaggtgatgcacccaccttggcctcccaaagtgctgggattccaggagtgagccaccatgcccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366276 - DNA, 1756 bp, Homo sapiens
ctgttgcgaggagtgagactttaagcgaagaacgtctcccattgctttaccgtctcatttattcacagaaatggaaatgttcctggtggtactaagcataattggcgcagaggagtctgaatggttcatcagaccatcattggtcttggaggcctagactggaacacgtcactttctgaaatgtagatgaataaggttcaaccccaaatggagggtattttcagtctgtggaactgatcagccctgagagagggtcggcagttaaccaatcaaatgtaggcttatcaagtcaaactaaaggagcttaagtggaagacatgaaaagtcaggagtgaccttagcaggtaaaggtaatggtgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366277 - DNA, 2408 bp, Homo sapiens
cccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaacagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366278 - DNA, 1732 bp, Homo sapiens
cccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366279 - DNA, 1448 bp, Homo sapiens
cccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgacccctaccaagcaacccctagggcttgcttggttggacaaaagtggaaagctacactgggaagttactcccttccttcaatgtctcagtgacagcgatgaggggtcctcaaaagacctcgagtttcccgaaccgaatcaccgtaagaaggacagggctagggcatttggccaggatggccaccctcctgctgttgccccttagtgaggaatcttcaccccacttcctctacccccaggttctcctccaccacagccagtcccctttcctcgctggacttaagggccactgtcccatcacccactctgccactgcctccttccacaatctgtaaatctccttgccttagactcctcctgccctccaagctgtacgtctgtcttccagatcttacttgacatccagccccctccctcaccctcacctgcagtccactacaattagctctaaccaagcaa

SEQ ID NO: 366280 - DNA, 565 bp, Homo sapiens
ttaggtgatgacagtgggtgcagtgcgtcccgtcctctcctgcagctgggacactttcagagcaatggaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366281 - DNA, 401 bp, Homo sapiens
ggagaaagcacgtttcttacagcagcttgctgtcccccctccaggttctgaccacatccgtgagaaagatggactgtgggctgtccttgcctggctctccatcctagccacccgcaagcagagtgtggaggacattctcaaagatcattggcaaaagtatggccggaatttcttcaccaggtgagccacagcccagctggggtacaaggtaaggtggggaagtgggcagagagaattcttgcgcatccacagcctctcctgtcttaagtgctaataaaaccctaggtcatccagcctctctcaattggagactttaaaaataatctggtcagggatgaaatgaagtcaatttttatgtcagccataaagagtgaggctttaaaagtttagctaacataatc

SEQ ID NO: 366282 - DNA, 2441 bp, Homo sapiens
cccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366283 - DNA, 1457 bp, Homo sapiens
caaaggtacgaaggcgccgcggtggcttaaatccatatggaacatgatctgtagctgctttgatggaatgggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366284 - DNA, 1052 bp, Homo sapiens
cgtcctccaccacttaatgcattaggtacgagctgggtgtaaatcagtgccgaggctggcattcttcaccagtgtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366285 - DNA, 1325 bp, Homo sapiens
cccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaatcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 366286 - DNA, 505 bp, Homo sapiens
agcaaaagtttctaattatcttgggtatctgcctaggagtggggtactctgaatattttaattcttactgcataaatacagacatgatggtgaagagtgttggatcttggatgagaatccaggtttctaattccatgttgctgctctttaggctcagcttcattgtgcgtttagtcctataccaaaaattggcagtgaaggtaaagacatcccaaaaagtcttgatacaccaatgctaactttgtcatagtgctgacgcagagtatgaaaagcttaagtttttttctcaagagtgaaatttgagctttgaacacaaagcagtatttgattctgtttattaaataaagttgtctacagcagcatgtcaggtgctgaggaggaatattaaagatgtgtgagatccggccggtcacatcccagtgctttgggaggccaaagtgggcggatcacaaggtcaggagttcaagaccagcctggccaatatggtgaaacccccgtctctact

SEQ ID NO: 366287 - DNA, 382 bp, Homo sapiens
ttacctcctttcttattttctttcctttgttgactctcatactctgttctcctaattctcccccttttccactccctgcccaccctgaaagacacacacacacacaataagtgggtggagtaagaagtcaacggagttggatataagcattcctgcttttctgacatctccagtgtcttggagaacaaggattctagaatgagggctcctcattatgcttcctttcaacattttttctctgtgttacttaagctttcaccccaagcatgtttgacagagagccagtgcattccccttactttttacaaaaataaaaaaagaaagaaaaagaaagaaagaaagaaaaagaaagaaagaaagaaagaaagaaagagaaagaaag

SEQ ID NO: 366288 - DNA, 732 bp, Homo sapiens
ggagtcaagctctgtcgcccaggctggagtgcagtggcacgatctcggctcactgcaacctccgcctcccaggttcaagcgattttcctgcctcagcctcctgagtaactgggattacaggtgcccgccaccacgtccggctaattttttttctatttttagtagagacgggggtttcactgttttggccaggctggtctcgagctcctgatctcgtgatccgcccgcttcggccttccaaagtgctgggattacaagcgtgagccaccgtgcccggctcatcctgcttttggtttcaggtctccatgccagtgaaatgtcacctcaactccaccgtccctggtgtcaggcaagcccgagggacccaattctgcctttcttctggattttcctaacctgttaagagtcttgaaagtccttaaaccacgggagactatctggcacatgacacgggatgagacttggtgggggtcccacgggggacaggtccttccagcggttcctctgcacccagcgctgcacgggcatggggcgtgggtaatcagcctcccgaaagccacgcgagtcacggtcctgcctgcgaagaactcccagggcgaccttggggctgaggagtgggcctgcttcggccttctgctcttctgttgtgtggtgaccctcaccagaggacagcttcatgctcttggacttcccagcctcaagaactgtaagaaataaatttctttataagtt

SEQ ID NO: 366289 - DNA, 772 bp, Homo sapiens
ggagtcaagctctgtcgcccaggctggagtgcagtggcacgatctcggctcactgcaacctccgcctcccaggttcaagcgattttcctgcctcagcctcctgagtaactgggattacaggtgcccgccaccacgtccggctaattttttttctatttttagtagagacgggggtttcactgttttggccaggctggtctcgagctcctgatctcgtgatccgcccgcttcggccttccaaagtgctgggattacaagcgtgagccaccgtgcccggctcatcctgcttttggtttcaggtctccatgccagtgaaatgtcacctcaactccaccgtccctggtgtcaggcaagcccgagggacccaattctgcctttcttctggattttcctaacctgttaagagtcttgaaagtccttaaaccacgggagactatctggcacatgacacgggatgagacttggtgggggtcccacgggggacaggtccttccagcggttcctctgcacccagcgctgcacgggcatggggcgtgggtaatcagcctcccgaaagccacgcgagtcacggtcctgcctgcgaagaactcccagggcgaccttggggctgaggagtgggcctgcttcggccttctgctcttctgttgtgtggtgaccctcaccagaggacagcttcatgctcttggacttcccagcctcaagaacttcttgctctgttgcccaggctagaatgcagaggcaccatcttggctcactgcaacctccgcctacc

SEQ ID NO: 366290 - DNA, 882 bp, Homo sapiens
ggagtcaagctctgtcgcccaggctggagtgcagtggcacgatctcggctcactgcaacctccgcctcccaggttcaagcgattttcctgcctcagcctcctgagtaactgggattacaggtgcccgccaccacgtccggctaattttttttctatttttagtagagacgggggtttcactgttttggccaggctggtctcgagctcctgatctcgtgatccgcccgcttcggccttccaaagtgctgggattacaagcgtgagccaccgtgcccggctcatcctgcttttggtttcaggtctccatgccagtgaaatgtcacctcaactccaccgtccctggtgtcaggcaagcccgagggacccaattctgcctttcttctggattttcctaacctgttaagagtcttgaaagtccttaaaccacgggagactatctggcacatgacacgggatgagacttggtgggggtcccacgggggacaggtccttccagcggttcctctgcacccagcgctgcacgggcatggggcgtgggtaatcagcctcccgaaagccacgcgagtcacggtcctgcctgcgaagaactcccagggcgaccttggggctgaggagtgggcctgcttcggccttctgctcttctgttgtgtggtgaccctcaccagaggacagcttcatgctcttggacttcccagcctcaagaactgtaagaaataaatttctttataagttgcccagtctgtggtatttggttatagcagcaggaaatggagtgagacaatgccctttaccagatcaaattccctttcatttctactttgctgtttttaccattaatagaatgtgaaatataacaataaacaataacgtttgacacattga

SEQ ID NO: 366291 - DNA, 181 bp, Homo sapiens
gttcttcctaggcagcccaccacgcgcagaggctgggtgtgtccctcttggggccggcggctgccagggaggacccgggtctaccctccctccccagggatgggcctggtccctccaagtactccttgtgggccaagagcctgtgtacagaggcattaagtgtctgttgaatgaacggtgg

SEQ ID NO: 366292 - DNA, 474 bp, Homo sapiens
ttttttttttggagagacagggttttgccctgctgcccaggctgatcttgcactcccgagcttaagcgatccactggctttggcccccaaaagtgctgggattacaggcgtgagccactatgcctggccagaatctgagcttttaaccattacaggtgctgctgcctccggaaaaggacagactgtaacccatgctttgaggacgaaaagcatctcaggaagggaaaacagggtgccttctggggaatttaaagcaacccttttgggctggggttaggggacagaggttaagatgaggtaagagagccttaggctacattgttaatgacttggagtctgtgcttatatgaccaagtcacttaggggtttctgagcagaataataaagtgacaacattttaagattgatgcagtagtgacatgtaggtgcatgttaactagtaagagtgtgtactgcagtgatagtggcaactga

SEQ ID NO: 366293 - DNA, 218 bp, Homo sapiens
gatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatct

SEQ ID NO: 366294 - DNA, 746 bp, Homo sapiens
ggaagagaccgagttttaggaaaaacatcaaagctggataggttgggcagaagagctggggatagcatttagagaggctgagagtcctgggttctgggttatcaaggtgagagaaaccagaggttgccagttgtaggtgggcgtcaggactagagtgatgcttccagaagtttctgcaagtgggccgagtctaaggtagggcagggtacgccagaagttgaggggcactaggtagacaggccgagctggtggctgggtgctcccctcaccctccatgctgctaggagcccgtgagcagggacttgctctcctctccctccctcctggggcctgcctgtctgtctgtgaactcttgtcggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366295 - DNA, 1018 bp, Homo sapiens
tggaaagagctgagtgggctgtttggctagcgtacgcgcatttgtttaaaaggaaagggtgtgtttcttggcaaagactcttcggaggaaacgctgaactggggatgggtctctacctgttctggggcctcactgcccttcctgccggggacaggcagtcactggtgggtttccccccagtggaaacacaatattttggaaatatttgtatctaggataaaacttcatctggaccaacatgtctttgttggtgttgtggcccaggtgattttaagaatgtagaatacatttggcaatttccaaacggagtgatgacctgctcctccgccccccatgccctccctgaggctggaggcttcagaagcccctgccttgggaggaggctgttctacctgagaagtctttgtccccaccgttggtgacaatcagcattgacctgtgaggcacctgccaggttcgggacgcagctttagacatccagaaaaccgggggtggaggggtggggtgggggcttaagaccccagagcttgattccttttaactgtctcatccccaaagaatggtacatgggtaccaggtaggttacttgaatcaccctgagcctcgattttcccacccgttagaaacagggtaattcatgacagtgtccgcttgggagacggctgtgacccctgagaattctcgctgcatgccgtgggctggctcgtgagactcaaggtctgggttcgaggcccccgcaaccccttctgactgtgtggcctgggcgagtttgttgtttgtaacctggaaagcgtcacacctgcctggcacggttattgtgggcttcaatgagattgtttgtgtgaaataaacgctttgtgactggcacacaggcgctctcatcccggctctcctggtgggcccggaccgctgggtgctacagggctgttgtgaggggcgctgtgatgcggttccaaagcacagggcttggcgcaccccactgtgctctcaataaatgtgtttcctgtcttaacaaaaa

SEQ ID NO: 366296 - DNA, 504 bp, Homo sapiens
tgggggcttgaagacataaccgtggttatccaggctgcggcggtagaagctggcattgaagggctcagggttctctgtccagtcctcagctgccctggagcacccaagaggcagactggtaggtaaggggtggcttgtcggggacagtggtctccacaaatgcaaggaggcctctgggcagaacaaatgcaggttccctggcaggggcagggtttgggtagtgggataggtcacttacttgttggggaagtctggaagtggggtaagctagggtccagggtaggttcagggcacacacccctcattgttaacctcgcagtccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366297 - DNA, 1045 bp, Homo sapiens
tggaaagagctgagtgggctgtttggctagcgtacgcgcatttgtttaaaaggaaagggtgtgtttcttggcaaagactcttcggaggaaacgctgaactggggatgggtctctacctgttctggggcctcactgcccttcctgccggggacaggcagtcactggtgggtttccccccagtggaaacacaatattttggaaatatttgtatctaggataaaacttcatctggaccaacatgtctttgttggtgttgtggcccaggtgattttaagaatgtagaatacatttggcaatttccaaacggagtgatgacctgctcctccgccccccatgccctccctgaggctggaggcttcagaagcccctgccttgggaggaggctgttctacctgagaagtctttgtccccaccgttggtgacaatcagcattgacctgtgaggcacctgccaggttcgggacgcagctttagacatccagaaaaccgggggtggaggggtggggtgggggcttaagaccccagagcttgattccttttaactgtctcatccccaaagaatggtacatgggtaccaggtaggttacttgaatcaccctgagcctcgattttcccacccgttagaaacagggtaattcatgacagtgtccgcttgggagacggctgtgacccctgagaattctcgctgcatgccgtgggctggctcgtgagactcaaggtctgggttcgaggcccccgcaaccccttctgactgtgtggcctgggcgagtttgttgtttgtaacctggaaagcgtcacacctgcctggcacggttattgtgggcttcaatgagattgtttgtgtgaaataaacgctttgtgactggcacacaggcgctctcatcccggctctcctggtgggcccggaccgctgggtgctggctgcggaggccctgtgctccctggaactgtctgcgctggtcccagggactcttgggcagagtggagggcaagggggaaagcaccagcctgctctggggagacagtggcagagggaagtgtttgct

SEQ ID NO: 366298 - DNA, 528 bp, Homo sapiens
aattagccgggcgtggtggtgggcgcctgtaatcccagctactcaggaggctgcggcaggagaatcacttgaacctggaaggcagaggttgcggtgagctgagatagcaccatccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggggtcctaagcctttgggtcccacagagcacgacttcgctccgtgaacagcaccaacccaagtctgttccatgtctccacacctgccccttccgctccataggcagctggtgggtgagtggagtcaggagagaa

SEQ ID NO: 366299 - DNA, 412 bp, Homo sapiens
gtgctggggcctcaggggtctgctcttcttctctttcagaatctggggctccaggctatgccttggctggactgaggtctgggggtgcacttattatccctggggacacctgctaagcttctccctgacaagctgtgtcactgatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagatagagctaaggaaaggcaaaaatgaaactaaatgaaagcgaaagggaaaataaagaaaaaccaat

SEQ ID NO: 366300 - DNA, 7683 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366301 - DNA, 7558 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgactcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366302 - DNA, 7629 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggcttttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366303 - DNA, 7656 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366304 - DNA, 7714 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctgtcaccccactccaccgaaaagtaaactgcaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366305 - DNA, 7804 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctgtcaccccactccaccgaaaagtaaactgcaggtgaggccgtgcccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366306 - DNA, 7309 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366307 - DNA, 7647 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttccggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366308 - DNA, 12084 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtgggaggttgtagtgagccaagattgcaccactgcactccagcctgggctacagagcaagacactatcttagatccaaaaaag

SEQ ID NO: 366309 - DNA, 9158 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366310 - DNA, 8098 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaactagagggggggcccgctccccaatgggccctatagagagtcagttcacaatcaattgagtcgccttcaacaaccgtgggactggaaaaaccctgcctgcacccaactaaattgcttggcagcaaatacacctttctgcagctggcttattaactagcaggccggcacggatcgaacttcctaacaatggcgtcacctgcatgggtgaacggcaggttggttggcgggaatacttatgttaaagccaaatcccctcataaattaatagaatgatccgacatagggtggactggtgttccattctggaccatcaatccattattaaggacggagctttcaaccacgaagggggaaacacctctgtttggg

SEQ ID NO: 366311 - DNA, 8056 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaggacaaagacggccataaagacgaaagagacagacagtgcagaataaaattcgagaagcgttccgcgagcctgagtaagatggagatggctatattattgctgtagaacgtcgcaatgtgaaacccaggcggggggaccgggtaccgatgacgaaaacgtggagatgatcacggtaacgggtcgtgccttaaaaggtatgggcacgataaccaggtggtaccaccgatcaaagcactgtgaagaccatcgcctctatcgcgatgggcgggaatgatcaacagttgctcaccctgagcatttcttgttcttcttcggggagagaattcaggggctcgcatttacgggaaccgagaacctgttcctttatttccc

SEQ ID NO: 366312 - DNA, 8241 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaaaaaaaaaaaaaaaaaaaaaaaaaaaaaaaaaaaaaaaaaaaaaaaaaaaaaaaaaaaaaaaaaaaaacaaaaaaaaatataacataaaagaaaaaaaaataataaacaaccaaaaatctaaaataaaaccgtggccctttttttaaaaaccatgctaaagggaaaacccttgccgtgccccaatttaaccgtttgggagaaatccccttttcgcggggggttattttcaaagggcccctcgcaaacccttgtcaaacagtccaaaccctgatggcaaaggcaattttacgctttattttttgtaaaatcccttaaattttggccaaaaacctgttttttacccaataggccaaatgcctaaatccctttaaattaaagaaattccccgaataggttggacttctccacatttgaaccaaagtcccttttaaaaaagggcttcaactgcaagggggctcgttttagggctgtgcgcctttggaaccatccccttataaatattgaggtcaggggcacaggattatattgcaccctgggacctcctttttctcct

SEQ ID NO: 366313 - DNA, 4707 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagttcctgacctggccatcccggggtgcccttgaccagccccgtgtctcctcagggtgtcccagcaccagcctggcacagagtggggctcagttagagtatgtgggatgttggtttcgccagtccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366314 - DNA, 7682 bp, Homo sapiens
  misc_feature (7272)..(7272): n is a, c, g, or t
  misc_feature (7274)..(7274): n is a, c, g, or t
  misc_feature (7276)..(7276): n is a, c, g, or t
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggncngnaagccatcacctggatcctacgtggaaggacctgggtgggggagggggggggggtgttcattcttaaattcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366315 - DNA, 8769 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaa

SEQ ID NO: 366316 - DNA, 4438 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366317 - DNA, 7515 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366318 - DNA, 7404 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggggtcctaagcctttgggtcccacagagcacgacttcgctccgtgaacagcaccaacccaagtctgttccatgtctccacacctgccccttccgctccataggcagctggtgggtgagtggagtcaggagagaa

SEQ ID NO: 366319 - DNA, 7381 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366320 - DNA, 7208 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccaacagggctgttgtgaggggcgctgtgatgcggttccaaagcacagggcttggcgcaccccactgtgctctcaataaatgtgtttcctgtcttaacaaaaa

SEQ ID NO: 366321 - DNA, 7202 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtagagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggtgggtgttgcccccgcctgcctttgcctccgccgtggccctgagagtcctgggctctgccccgcccggtcccttgctcccc

SEQ ID NO: 366322 - DNA, 3480 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaagtccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgttccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366323 - DNA, 7008 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactctgctttgctctgtctcctgaggtgggcctgaccaacctccccttctctgcctcagtccctgggctccagggctcagctccacagccctctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366324 - DNA, 3331 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366325 - DNA, 3451 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaagttcctgacctggccatcccggggtgcccttgaccagccccgtgtctcctcagggtgtcccagcaccagcctggcacagagtggggctcagttagagtatgtgggatgttggtttcgccaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366326 - DNA, 6453 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctgctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366327 - DNA, 6263 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcctcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcatgtatcctctcctcgcatctcctcacatggaaagaaataaatgtatttgtgccttctgtgaggaatggggggacaaatgtccca

SEQ ID NO: 366328 - DNA, 4585 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagcctgggctacagagcaagacactatcttagatccaaaaaag

SEQ ID NO: 366329 - DNA, 7732 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaacccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtgggaggttgtagtgagccaagattgcaccactgcactccagcctgggctacagagcaagacactatcttagatccaaaaaag

SEQ ID NO: 366330 - DNA, 4538 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatcctgggctacagagcaagacactatcttagatccaaaaaag

SEQ ID NO: 366331 - DNA, 4466 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgagtaatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgcactctagcctgggcagcagagcaagactccgcctcaa

SEQ ID NO: 366332 - DNA, 3365 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagac

SEQ ID NO: 366333 - DNA, 3739 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgccccacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttggggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacacaccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccccaagcttcttgaaaggcctgtctacacttgctgtcttccttcctcacctccaatttcctcttcaacccactgcttcctgactcgctctactccgtggaagcacgctcacaaaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaaaaaaacaaaaaaacaaagaacgaaaagagcacaacagacgaagaacagaaaaagaaagggggggggcgccgccaaagaaccccccggggggcgcccgagtaggggacccggcgtttgcgtacgaggggggccccaaaagaggcaccagctatataaaagcgaggacgcgggcggccgcggcttaaaccgagggggggggaggcgaaaaaccggcgactgggacaacacttgtgtgaggagaaaccccatatgggaggggggcacacattgtgggggacaactccccgaagagaatattatgcgctcgtgggggacatattcaccttgagggttatcggtgttaacgcagcgaggtaatgcgcggcgcgagacaatgtgtccacggcagtgtattgagacaatttccgg

SEQ ID NO: 366334 - DNA, 656 bp, Homo sapiens
agttctggatttggggctgcccctaacccagcccgttgctgctttgcaccttttcctgtcattgggcatcccccagtagtcaccccactccaccgaaaagtaaactgcaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 366335 - DNA, 403 bp, Homo sapiens
atatcagggtggtttataaagcctgtaaacacacctaagaaaataaacattttacaaatgaaaaaaaaaaaaaaaaaaaaaaaaaagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacggtacttcaaccctcctgctatcatttcataaccaacgtggcgggcagaatctcccaaccccaccaccatccttgcaccacccccagacccactagcaattaaaagacaattttaaattttaa

SEQ ID NO: 366336 - DNA, 451 bp, Homo sapiens
cctgatagctgcatcaaacccactattatccagccacatggaaccattacattctctgaaaacacctcttgctttttcccctattttgctcacactattacacgacctgaagtgtcctttattcctctttaaggacctccacatgggtgccccctccaagagttgcctgccccgcatgaccatcccacattcagctcgctctaccctctctgcttggggactctcttccactctccttgctttagctccaccattaggctgatggttccgaaatctttttctagcctatgtttctatcacgaactttgattcagattcccagtttcttgtgggactgcttcatctagatgtctcactggagcttccaactcaacatgaccaaagctgaactcatcacctaacccccaaacctgctttctccttatttggtggcaacaccatccatctactc

SEQ ID NO: 366337 - DNA, 1047 bp, Homo sapiens
  misc_feature (95)..(95): n is a, c, g, or t
  misc_feature (107)..(107): n is a, c, g, or t
  misc_feature (117)..(117): n is a, c, g, or t
  misc_feature (126)..(126): n is a, c, g, or t
  misc_feature (1023)..(1024): n is a, c, g, or t
cccccccccagaagcgttttttaaaaccccctacgccgagagccaccaacaaccggaggagaaaaaacggcgcagagaagaaagaccaaaaaaanggccggccaggncacacctaanccacgccancggcaacttgagccccggagttcaagaccagcttgggcaacatggcaaaaccctgtctctacaaaaaatacaaaaattagctaggcatggtggtgtgcaccagtatttctagctactcaggaggctgaggtgggagaatcacccgagcccgagaaggttgaggctgcagtgagccatgattgtgccattgcactcccgcctggggaagagtgagaccgtcttaaaacaagcaaacaaaaaaccatcaaggaatagtcatgaaaacatgttcatattgagacatggaggtaaatacaaacaaatcagccaagagttggacagactactgtgaggcaaggaaagtggggtaaaggcagggtaggagggctactgtttttcataataaaccttatggaacaacttgttttcaatctgcgtcaactgattttcccccctaagatgcaggatataaaactgtttacaaagctacatattttaggttgatcccccttcacttttcagatctaggtagggttatagccagtttccattgcgtggagaatctgcaaggctggtgttcctgtacgggtccagagtgaactacatcaaaagtcgcttttgatatcgaggatgcagttcactactattaagtgtaatgtgttattactcaaagtaagtactgtttactgtaaaagtatgatgaattcagtaatgattatactaaaataacatactagtacagggtcaaaatacggctttaggtctacttaagatagaatacttaagaattacttatctggggaccagggaattgtttaaaatgcagattcctgggccccactccaggtgtgcggcttgcagtcttcatttctaataagatccttagttgatgttgaaaaccactgctttcatttgtcnnccccagcctcgctaacctagcct

SEQ ID NO: 366338 - DNA, 1900 bp, Homo sapiens
tttttgagacagagtcttgctctgttgcccaggctggagtgcagtggcgcgatctcagctcactgcaatcccgcctggggaagagtgagaccgtcttaaaacaagcaaacaaaaaaccatcaaggaatagtcatgaaaacatgttcatattgagacatggaggtaaatacaaacaaatcagccaagagttggacagactactgtgaggcaaggaaagtggggtaaaggcagggtaggagggctactgtttttcataataaaccttatggaacaacttgttttcaatctgcgtcaactgattttcccccctaagatgcaggatataaaactgtttacaaagctacatattttaggttgatcccccttcacttttcagatctaggtagggttatagccagtttccattgcgtggagaatctgcaaggctggtgttcctgtacgggtccagagtgaactacatcaaaagtcgcttttgatatcgaggatgcagttcactactattaagtgtaatgtgttattactcaaagtaagtactgtttactgtaaaagtatgatgaattcagtaatgattatactaaaataacatactagtacagggtcaaaatacggctttaggtctacttaagatagaatacttaagaattacttatctggggaccagggaattgtttaaaatgcagattcctgggccccactccaggtgtgcggcttgcagtcttcatttctaataagatccttagttgatgttgaaaaccactgctttcatttgttttttatttaagagacagggtctcactgtcatccaggctggagtgcagtggtgcaattatagctcactgcagccttaatctcctgggctcatgtggtcgtcctgcctcaacctccaggatagctgggactgcaggcatcagctgtgcccagctacttttcaattttttgtagagatgcggtcttggttaacaaagcttaacagcccaggctagtctcaaactcctaggttcaagtgatcctcccgcctcgacctcccaaagtgctggcattataggcgtggggcaccatgtttggcctgaagccctattttaaacgtctattgtatctgaccaactcactgatgcttattcctcagaataccagctctgtaacctccaggtagtatcataagacaaagcttattagaacctcattaattgatgccaggttaactaatgtgctggatttttttcccctcctctttcattacttgaataatctgttcaatgagcaatattctaaaagccaataattgatcagttttcctcttgatggcttatgctgtagctcataccataatgaatacctggcaagacctctttttggtgatttgattttttcaggctgcttttccagtttctgtgtttttgtcacaattattcaccctgtgtatcttatactctttactactacttatttttctttaaagacaaagtcttgctcttttgcccaggctggagtacagtggcaaggtcatagctcactgcagcctcatactcccaggctcaagtgatcctcccacctcagcctccctagtagcgaggactacaggtgtgcaccaccatgccaagttaatttttaaaattttttgtagagacagggtctcaccatgtctcgcgggctggttttgaactcctctcaaacaatcctctacctcagcctcccagagtgctggaagcaagccactgtgctgagctgctggtcacccttcctacattaacaactatggatgtgccaatcaatgctgagatgctctgatatgctcccaagaatctgtttccacaaatcaccacaaaactacttgttgtagccagtatacgagccaaggaagctggccactaggatcccctgaattatcttttttttttga

SEQ ID NO: 366339 - DNA, 964 bp, Homo sapiens
tcccccgccctgttttattctcctcctgtggcccgcgggagagcccccttgccctctgatcccccccttgggagtttctccaaaccccggtgtcccccacgcggtttttatatgggtgaaaggcgcccgccccactgtgttgctgtgcccacggtgtcctcctttgggacccgacgctatggcccgcgtgacaagcataccccatctgggtccacgcccccctcaccacacggtggtgtactaaaaacctctttctcacgggcccgcgccgccccacacaactgttttttttttttttttttttcttttttctttgtttttttaaaaagtttaatcacatcttaataatttgacactgaatatgatctaaccagaattacaatatcagggagatgggtgagaggaagtaaattcatggtgggcaggaggaagagaggattcaaaagataatggtggccgggtgcagtggctcacacctataatcccagcaggccgaggcgggcagatcacttgagccccggagttcaagaccagcttgggcaacatggcaaaaccctgtctctacaaaaaatacaaaaattagctaggcatggtggtgtgcaccagtatttctagctactcaggaggctgaggtgggagaatcacccgagcccgagaaggttgaggctgcagtgagccatgattgtgccattgcactcccgcctggggaagagtgagaccgtcttaaaacaagcaaacaaaaaaccatcaaggaatagtcatgaaaacatgttcatattgagacatggaggtaaatacaaacaaatcagccaagagttggacagactactgtgaggcaaggaaagtggggtaaaggcagggtaggagggctactgtttttcataataaaccttatggaacaaagataaatggaaaaacaggagtgggaggtagaagaaggaataaaacaaagaactgacattcc

SEQ ID NO: 366340 - DNA, 959 bp, Homo sapiens
tcccccgccctgttttattctcctcctgtggcccgcgggagagcccccttgccctctgatcccccccttgggagtttctccaaaccccggtgtcccccacgcggtttttatatgggtgaaaggcgcccgccccactgtgttgctgtgcccacggtgtcctcctttgggacccgacgctatggcccgcgtgacaagcataccccatctgggtccacgcccccctcaccacacggtggtgtactaaaaacctctttctcacgggcccgcgccgccccacacaactgttttttttttttttttttttcttttttctttgtttttttaaaaagtttaatcacatcttaataatttgacactgaatatgatctaaccagaattacaatatcagggagatgggtgagaggaagtaaattcatggtgggcaggaggaagagaggattcaaaagataatggtggccgggtgcagtggctcacacctataatcccagcaggccgaggcgggcagatcacttgagccccggagttcaagaccagcttgggcaacatggcaaaaccctgtctctacaaaaaatacaaaaattagctaggcatggtggtgtgcaccagtatttctagctactcaggaggctgaggactacaggtgtgcaccaccatgccaagttaatttttaaaattttttgtagagacagggtctcaccatgtctcgcgggctggttttgaactcctctcaaacaatcctctacctcagcctcccagagtgctggaagcaagccactgtgctgagctgctggtcacccttcctacattaacaactatggatgtgccaatcaatgctgagatgctctgatatgctcccaagaatctgtttccacaaatcaccacaaaactacttgttgtagccagtatacgagccaaggaagctggccactaggatcccctgaattatcttttttttttga

SEQ ID NO: 366341 - DNA, 1363 bp, Homo sapiens
tcccccgccctgttttattctcctcctgtggcccgcgggagagcccccttgccctctgatcccccccttgggagtttctccaaaccccggtgtcccccacgcggtttttatatgggtgaaaggcgcccgccccactgtgttgctgtgcccacggtgtcctcctttgggacccgacgctatggcccgcgtgacaagcataccccatctgggtccacgcccccctcaccacacggtggtgtactaaaaacctctttctcacgggcccgcgccgccccacacaactgttttttttttttttttttttcttttttctttgtttttttaaaaagtttaatcacatcttaataatttgacactgaatatgatctaaccagaattacaatatcagggagatgggtgagaggaagtaaattcatggtgggcaggaggaagagaggattcaaaagataatggtggccgggtgcagtggctcacacctataatcccagcaggccgaggcgggcagatcgcgtggggcaccatgtttggcctgaagccctattttaaacgtctattgtatctgaccaactcactgatgcttattcctcagaataccagctctgtaacctccaggtagtatcataagacaaagcttattagaacctcattaattgatgccaggttaactaatgtgctggatttttttcccctcctctttcattacttgaataatctgttcaatgagcaatattctaaaagccaataattgatcagttttcctcttgatggcttatgctgtagctcataccataatgaatacctggcaagacctctttttggtgatttgattttttcaggctgcttttccagtttctgtgtttttgtcacaattattcaccctgtgtatcttatactctttactactacttatttttctttaaagacaaagtcttgctcttttgcccaggctggagtacagtggcaaggtcatagctcactgcagcctcatactcccaggctcaagtgatcctcccacctcagcctccctagtagcgaggactacaggtgtgcaccaccatgccaagttaatttttaaaattttttgtagagacagggtctcaccatgtctcgcgggctggttttgaactcctctcaaacaatcctctacctcagcctcccagagtgctggaagcaagccactgtgctgagctgctggtcacccttcctacattaacaactatggatgtgccaatcaatgctgagatgctctgatatgctcccaagaatctgtttccacaaatcaccacaaaactacttgttgtagccagtatacgagccaaggaagctggccactaggatcccctgaattatcttttttttttga

SEQ ID NO: 366342 - DNA, 2528 bp, Homo sapiens
tcccccgccctgttttattctcctcctgtggcccgcgggagagcccccttgccctctgatcccccccttgggagtttctccaaaccccggtgtcccccacgcggtttttatatgggtgaaaggcgcccgccccactgtgttgctgtgcccacggtgtcctcctttgggacccgacgctatggcccgcgtgacaagcataccccatctgggtccacgcccccctcaccacacggtggtgtactaaaaacctctttctcacgggcccgcgccgccccacacaactgttttttttttttttttttttcttttttctttgtttttttaaaaagtttaatcacatcttaataatttgacactgaatatgatctaaccagaattacaatatcagggagatgggtgagaggaagtaaattcatggtgggcaggaggaagagaggattcaaaagataatggtggccgggtgcagtggctcacacctataatcccagcaggccgaggcgggcagatcacttgagccccggagttcaagaccagcttgggcaacatggcaaaaccctgtctctacaaaaaatacaaaaattagctaggcatggtggtgtgcaccagtatttctagctactcaggaggctgaggtgggagaatcacccgagcccgagaaggttgaggctgcagtgagccatgattgtgccattgcactcccgcctggggaagagtgagaccgtcttaaaacaagcaaacaaaaaaccatcaaggaatagtcatgaaaacatgttcatattgagacatggaggtaaatacaaacaaatcagccaagagttggacagactactgtgaggcaaggaaagtggggtaaaggcagggtaggagggctactgtttttcataataaaccttatggaacaacttgttttcaatctgcgtcaactgattttcccccctaagatgcaggatataaaactgtttacaaagctacatattttaggttgatcccccttcacttttcagatctaggtagggttatagccagtttccattgcgtggagaatctgcaaggctggtgttcctgtacgggtccagagtgaactacatcaaaagtcgcttttgatatcgaggatgcagttcactactattaagtgtaatgtgttattactcaaagtaagtactgtttactgtaaaagtatgatgaattcagtaatgattatactaaaataacatactagtacagggtcaaaatacggctttaggtctacttaagatagaatacttaagaattacttatctggggaccagggaattgtttaaaatgcagattcctgggccccactccaggtgtgcggcttgcagtcttcatttctaataagatccttagttgatgttgaaaaccactgctttcatttgttttttatttaagagacagggtctcactgtcatccaggctggagtgcagtggtgcaattatagctcactgcagccttaatctcctgggctcatgtggtcgtcctgcctcaacctccaggatagctgggactgcaggcatcagctgtgcccagctacttttcaattttttgtagagatgcggtcttggttaacaaagcttaacagcccaggctagtctcaaactcctaggttcaagtgatcctcccgcctcgacctcccaaagtgctggcattataggcgtggggcaccatgtttggcctgaagccctattttaaacgtctattgtatctgaccaactcactgatgcttattcctcagaataccagctctgtaacctccaggtagtatcataagacaaagcttattagaacctcattaattgatgccaggttaactaatgtgctggatttttttcccctcctctttcattacttgaataatctgttcaatgagcaatattctaaaagccaataattgatcagttttcctcttgatggcttatgctgtagctcataccataatgaatacctggcaagacctctttttggtgatttgattttttcaggctgcttttccagtttctgtgtttttgtcacaattattcaccctgtgtatcttatactctttactactacttatttttctttaaagacaaagtcttgctcttttgcccaggctggagtacagtggcaaggtcatagctcactgcagcctcatactcccaggctcaagtgatcctcccacctcagcctccctagtagcgaggactacaggtgtgcaccaccatgccaagttaatttttaaaattttttgtagagacagggtctcaccatgtctcgcgggctggttttgaactcctctcaaacaatcctctacctcagcctcccagagtgctggaagcaagccactgtgctgagctgctggtcacccttcctacattaacaactatggatgtgccaatcaatgctgagatgctctgatatgctcccaagaatctgtttccacaaatcaccacaaaactacttgttgtagccagtatacgagccaaggaagctggccactaggatcccctgaattatcttttttttttga

SEQ ID NO: 366343 - DNA, 1200 bp, Homo sapiens
tcccccgccctgttttattctcctcctgtggcccgcgggagagcccccttgccctctgatcccccccttgggagtttctccaaaccccggtgtcccccacgcggtttttatatgggtgaaaggcgcccgccccactgtgttgctgtgcccacggtgtcctcctttgggacccgacgctatggcccgcgtgacaagcataccccatctgggtccacgcccccctcaccacacggtggtgtactaaaaacctctttctcacgggcccgcgccgccccacacaactgttttttttttttttttttttcttttttctttgtttttttaaaaagtttaatcacatcttaataatttgacactgaatatgatctaaccagaattacaatatcagggagatgggtgagaggaagtaaattcatggtgggcaggaggaagagaggattcaaaagataatggtggccgggtgcagtggctcacacctataatcccagcaggccgaggcgggcagatcacttgagccccggagttcaagaccagcttgggcaacatggcaaaaccctgtctctacaaaaaatacaaaaattagctaggcatggtggtgtgcaccagtatttctagctactcaggaggctgaggtgggagaatcacccgagcccgagaaggttgaggctgcagtgagccatgattgtgccattgcactcccgcctggggaagagtgagaccgtcttaaaacaagcaaacaaaaaaccatcaaggaatagtcatgaaaacatgttcatattgagacatggaggtaaatacaaacaaatcagccaagagttggacagactactgtgaggcaaggaaagtggggtaaaggcagggtaggagggctactgtttttcataataaaccttatggaacaacttgttttcaatctgcgtcaactgattttcccccctaagatgcaggatataaaactgtttacaaagctacatattttaggttgatcccccttcacttttcagatctaggtagggttatagccagtttccattgcgtggagaatctgcaaggctcctcgtgccgaattcggcacgaggcgcaatgctttttttttttttttttttaaataaaaatgctgcaaggtttccgcctctgcgttccccttgtgatggctggcaggtggtctggaagcgtcccggatggcggccaagccgcgct

SEQ ID NO: 366344 - DNA, 1411 bp, Homo sapiens
tcccccgccctgttttattctcctcctgtggcccgcgggagagcccccttgccctctgatcccccccttgggagtttctccaaaccccggtgtcccccacgcggtttttatatgggtgaaaggcgcccgccccactgtgttgctgtgcccacggtgtcctcctttgggacccgacgctatggcccgcgtgacaagcataccccatctgggtccacgcccccctcaccacacggtggtgtactaaaaacctctttctcacgggcccgcgccgccccacacaactgttttttttttttttttttttcttttttctttgtttttttaaaaagtttaatcacatcttaataatttgacactgaatatgatctaaccagaattacaatatcagggagatgggtgagaggaagtaaattcatggtgggcaggaggaagagaggattcaaaagataatggtggccgggtgcagtggctcacacctataatcccagcaggccgaggcgggcagatcgttcaagtgatcctcccgcctcgacctcccaaagtgctggcattataggcgtggggcaccatgtttggcctgaagccctattttaaacgtctattgtatctgaccaactcactgatgcttattcctcagaataccagctctgtaacctccaggtagtatcataagacaaagcttattagaacctcattaattgatgccaggttaactaatgtgctggatttttttcccctcctctttcattacttgaataatctgttcaatgagcaatattctaaaagccaataattgatcagttttcctcttgatggcttatgctgtagctcataccataatgaatacctggcaagacctctttttggtgatttgattttttcaggctgcttttccagtttctgtgtttttgtcacaattattcaccctgtgtatcttatactctttactactacttatttttctttaaagacaaagtcttgctcttttgcccaggctggagtacagtggcaaggtcatagctcactgcagcctcatactcccaggctcaagtgatcctcccacctcagcctccctagtagcgaggactacaggtgtgcaccaccatgccaagttaatttttaaaattttttgtagagacagggtctcaccatgtctcgcgggctggttttgaactcctctcaaacaatcctctacctcagcctcccagagtgctggaagcaagccactgtgctgagctgctggtcacccttcctacattaacaactatggatgtgccaatcaatgctgagatgctctgatatgctcccaagaatctgtttccacaaatcaccacaaaactacttgttgtagccagtatacgagccaaggaagctggccactaggatcccctgaattatcttttttttttga

SEQ ID NO: 366345 - DNA, 676 bp, Homo sapiens
acataacttttattactgtgtattgttataattgttttctcattagttattgttaatttgttactgtgcctaatttataaattaaactttatcataggtatgtatgtaaaggggaaacacagcatatatagggttcagtactcgccaccatttcgggcatccactggggttggaggtcttggaacatccccccatagataaggagtgactatatagcactatagtgtattatggcaattaaaaaccttgtatctgtgaattagacaaaggtgaagagacaattagtgaatgggaagctagatctgaagttttccaaaatgcagcccagcaagataaacagtgataatgtaaagcaagtggctgagagacatggagagtagaatgaagagatccaacgtaaagtgacggagttccaggtgggaaaaaaaaaaaatgaaaatgaggcagaagcaatatttaaaaactggctgagaactttccagaaaaaatcaccaattcacagattcaagaagaccagtaagtctcaggcaggttaataggaagaactatacatccaaatgttctgtttcttcatctgggtgatgattaggtatttttactttatgaatattcattgaactgtatacatgttttatgccctttttgtatgtttattctaagtaagcaaatttactta

SEQ ID NO: 366346 - DNA, 235 bp, Homo sapiens
gggtagacaaattcttctccgttgcttttggtccaagtagggcttctgattaatactgaagagcatttaaaaagtacttttgccgtttcgctctttaaatcagtatagcttatgtcccctgaggagtgtggtttaattattcttggttcatttttaccccaggccaaaagtagaaatgtaaaacatacaagttttatgttatttccagatgttagtgtaagaacattaagtggat

SEQ ID NO: 366347 - DNA, 1804 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 366348 - DNA, 535 bp, Homo sapiens
ttgttaaactagatttttttgtgcagaatgtcagctggggtgtaataacttttactaacttgagaatgagagaagatgggaggagtggagctcaaatttaacacaaatgccaaagtataattcatctatgttttcttcctctagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 366349 - DNA, 469 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggtaagattttccccacccaatacccttcttcatctcctttttttccccccagtgctcttatggcatctcagaaatactgaaatcctggaatgctttgctagtttccagtgggtggcacttactatagggaggtggactgagcttttagggaaagcattgggtggcacttgctatagggaagtgaactgagttcttaaagaaatgtgtaggaacaagagagacttgctttagctgcctcttacaataaagtgtaaagctct

SEQ ID NO: 366350 - DNA, 605 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagacacctgctccctttcctggaacccttccaaatagtcttgatgtcagaacatttaatctctcctggaatgcagaagtgtggcccaacaggatcttctaagcctttgcaacacaaagtttgattcccagcaagatagcatcaacctcatctggagcttgttagaaatgcagaatcttggccccaccctagaactactggatcagaatttacattttagcaagatctccaggggatctgaatgtaaatcatatttaagaaaccctgctataaaccaccatct

SEQ ID NO: 366351 - DNA, 1640 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatataggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 366352 - DNA, 2170 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaataagtgtaaagtatattatcaaaataagaaaataatgctcttgcataaaacaaagtggctggaaatttaaacctccacaatgatcattggtacactaatgtagctgggctctccactgccaatgcttgacaattaagtcttggttaaaattttaatttgtagaaaataaggtattaaaggtaatgtatgatatctgtaagtataggcaagaaggatgtaatggttcctttttgtgagcactctcaaccatgggatatatatatatatggatatgaactttctataagttcttgtctaggattatgctgttagttttgcttactaaagataattataccctctttgatctacatgtctatcaaatagaacctaaacttgatatgaggtttgtattagtccattatcacgctgctaataaagacatactcaagactg

SEQ ID NO: 366353 - DNA, 1810 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtaagagtttgtcgccttaagcacctgaaaatttttagcagttgatcaggatgtataagagtatttggtagtaagcactaagaggctcagaaatgacagtgcccaggactttctcccctgggccacagtgtgtgcttctttggctggttgggcagacagcatcagtgacaacccatctctgtgtatcatagcccttccctgccttccccttcctcttccatgctttaatcttcccatctcacattatgaaagcacctgggtagttctcttcagctgccctcgcttcaaatggatttctcataaaacctaatacaatgtcacaagccaccatgttggccttgtaaacattgcaccaagaacagtttctgcagaggagtgaaaaaatgaaagagtgaaatatgccctgagtcctggttctttaaatttagtagtatgataagcctatgaaacatttcatccgtaaacccttcacagaacaacaaatgctatgaccaatgaattaccttaaaaagccagtgctacataagattaggcatggaaacagggtatgtttactctgaatatagtcactatggagaatatgatccagtacaagtgatacctcttcaggtaacattactcatctactactctcaactccatggtagccatattcaggtttcagtccgccatcatgtagcaaccctctcccgtactccgtacctatcaccaacagcttcaagacccacctgaattcccaagccacccattaccacaaaagaacaaatacacattccctccttaccaacccctctttaaaaaaacaaaaaagaacagaaaaaaacccatgaaatcccagagcaatggtgtgtattgcatctggtaggggaggtggagctattaattgggcccctccagtaaggggttcaatacactcttgatgaaaaacaaaaacaataaaactcctttatctcttagacctcccacttggcaaatgaaattcaaagccattattcactttaacaagatctctatcatcaaataatcaaataataatatatc

SEQ ID NO: 366354 - DNA, 1735 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 366355 - DNA, 920 bp, Homo sapiens
agctcatctctttttattccccaggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 366356 - DNA, 1566 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtaagagtttgtcgccttaagcacctgaaaatttttagcagttgatcaggatgtataagagtatttggtagtaagcactaagaggctcagaaatgacagtgcccaggactttctcccctgggccacagtgtgtgcttctttggctggttgggcagacagcatcagtgacaacccatctctgtgtatcatagcccttccctgccttccccttcctcttccatgctttaatcttcccatctcacattatgaaagcacctgggtagttctcttcagctgccctcgcttcaaatggatttctcataaaacctaatacaatgtcacaagccaccatgttggccttgtaaacattgcaccaagaacagtttctgcagaggagtgaaaaaatgaaagagtgaaatatgccctgagtcctggttctttaaatttagtagtatgataagcctatgaaacatttcatccgtaaacccttcacagaacaacaaatgctatgaccaatgaattaccttaaaaagccagtgctacataagattaggcatggaaacagggtatgtttactctgaatatagtcactatggagaatatgatccagtacaagtgatacctcttcaggtaacattactcatctactactctcaactccatggtagccatattcaggtttcagtccgccatcatgtagcaaccctctcccgtactccgtacctatcaccaacagcttcaagacccacctgaattcccaagccacccattaccacaaaagaacaaatacacattccctccttaccaacccctcttta

SEQ ID NO: 366357 - DNA, 1512 bp, Homo sapiens
agcaggggccttcgtggccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccccgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtaagagtttgtcgccttaagcacctgaaaatttttagcagttgatcaggatgtataagagtatttggtagtaagcactaagaggctcagaaatgacagtgcccaggactttctcccctgggccacagtgtgtgcttctttggctggttgggcagacagcatcagtgacaacccatctctgtgtatcatagcccttccctgccttccccttcctcttccatgctttaatcttcccatctcacattatgaaagcacctgggtagttctcttcagctgccctcgcttcaaatggatttctcataaaacctaatacaatgtcacaagccaccatgttggccttgtaaacattgcaccaagaacagtttctgcagaggagtgaaaaaatgaaagagtgaaatatgccctgagtcctggttctttaaatttagtagtatgataagcctatgaaacatttcatccgtaaacccttcacagaacaacaaatgctatgaccaatgaattaccttatatagtcactatggagaatatgatccagtacaagtgatacctcttcaggtaacattactcatctactactctcaactccatggtagccatattcaggtttcagtccgccatcatgtagcaaccctctcccgtactccgtacctatcaccaacagcttcaagacccacctgaattcccaagccacccattaccacaaaagaacaaatacacattccctccttaccaacccctcttta

SEQ ID NO: 366358 - DNA, 4588 bp, Homo sapiens
tgccgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcagatatttgattcaagtggcagccatggattttctggaactcagctacctcaaaactccagtaactccagtgaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggcctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgctgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctctgaaattatatgcaaagagttgtgggtcttcatcacacatttttctgtatacatcacagaggctcttaaagtgtgagatggagagctggcggggccgaagagtagggtctatgtctgccaactctaacagcctgcccgtgctttccaagcgctgcgcttcagggaataacattctgagccctcgatggcagtatttccttcggaactgaaatacattctgaaccactttttccaccagcttgaatggctgctctatcttgggctgtatcaagggagtgaagtgcaccacgcccacgtccaccttcgttgtaagcaaacatattatcattctgtggcatgatatgtggcatagtgtgatcaatcaactcatccttgtaaaacaggaagatgggctgtcaacagcctgttttcataaacagacctttccacgtacttcggtttcatctctaggcatggaagatggtacattctggattcgcaaatgacatggagaaatcagccggctgcacctgttctct

SEQ ID NO: 366359 - DNA, 3370 bp, Homo sapiens
ttcattgcctggggatgagagggagagacaacgtgtgtcttacacatctcccaacagccgacttagatgtgatccgttctcccagagggagcaggtttctttgaacttttcctttttatgtacagcatagtgctgagcagatcactgcactgtgcaggagttttaacgacagtcaggccaacggcatggaaggaccgcgggagaatcaggatcctcctccgaggcctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgctgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctctgaaattatatgcaaagagttgtgggtcttcatcacacatttttctgtatacatcacagaggctcttaaagtgtgagatggagagctggcggggccgaagagtagggtctatgtctgccaactctaacagcctgcccgtgctttccaagcgctgcgcttcagggaataacattctgagccctcgatggcagtatttccttcggaactgaaatacattctgaaccactttttccaccagcttgaatggctgctctatcttgggctgtatcaagggagtgaagtgcaccacgcccacgtccaccttcgttgtaagcaaacatattatcattctgtggcatgatatgtggcatagtgtgatcaatcaactcatccttgtaaaacaggaagatgggctgtcaacagcctgttttcataaacagacctttccacgtacttcggtttcatctctaggcatggaagatggtacattctggattcgcaaatgacatggagaaatcagccggctgcacctgttctct

SEQ ID NO: 366360 - DNA, 4469 bp, Homo sapiens
agggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggcctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgctgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctctgaaattatatgcaaagagttgtgggtcttcatcacacatttttctgtatacatcacagaggctcttaaagtgtgagatggagagctggcggggccgaagagtagggtctatgtctgccaactctaacagcctgcccgtgctttccaagcgctgcgcttcagggaataacattctgagccctcgatggcagtatttccttcggaactgaaatacattctgaaccactttttccaccagcttgaatggctgctctatcttgggctgtatcaagggagtgaagtgcaccacgcccacgtccaccttcgttgtaagcaaacatattatcattctgtggcatgatatgtggcatagtgtgatcaatcaactcatccttgtaaaacaggaagatgggctgtcaacagcctgttttcataaacagacctttccacgtacttcggtttcatctctaggcatggaagatggtacattctggattcgcaaatgacatggagaaatcagccggctgcacctgttctct

SEQ ID NO: 366361 - DNA, 4187 bp, Homo sapiens
agggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggcctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgctgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctctgaaattatatgcaaagagttgtgggtcttcatcacacatttttctgtatacatcacagaggctcttaaagtgtgagatggagagctggcggggccgaagagtagggtctatgtctgccaactctaacagcctgcccgtgctttccaagcgctgcgcttcagggaataacattctgaggggaagacagacagacagaaaaataagaattttacttaaattctgcaaatcatgacac

SEQ ID NO: 366362 - DNA, 4541 bp, Homo sapiens
agggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcagatatttgattcaagtggcagccatggattttctggaactcagctacctcaaaactccagtaactccagtgaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggcctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgctgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctctgaaattatatgcaaagagttgtgggtcttcatcacacatttttctgtatacatcacagaggctcttaaagtgtgagatggagagctggcggggccgaagagtagggtctatgtctgccaactctaacagcctgcccgtgctttccaagcgctgcgcttcagggaataacattctgagccctcgatggcagtatttccttcggaactgaaatacattctgaaccactttttccaccagcttgaatggctgctctatcttgggctgtatcaagggagtgaagtgcaccacgcccacgtccaccttcgttgtaagcaaacatattatcattctgtggcatgatatgtggcatagtgtgatcaatcaactcatccttgtaaaacaggaagatgggctgtcaacagcctgttttcataaacagacctttccacgtacttcggtttcatctctaggcatggaagatggtacattctggattcgcaaatgacatggagaaatcagccggctgcacctgttctct

SEQ ID NO: 366363 - DNA, 779 bp, Homo sapiens
tggaaacgtgcttacgtgaggacttcgtgatatgattttggctgctcagaagtcatatttgcttcctagttctcaagtgtgtccttaaagaagagatagggcaactcggtagaaagcaagcatttaaaaaacccattattatctgtcttgagtcctcactggggaaccacgagctccctggtacagagcctctgtgagctgtgcagtcaccaactccaggctgcgcttatgtttaagccaccctgagagaggccacctgaggtctagcaagtctttgctctctcctcattggcagtgaagtcttgtccgtcacaggcctgaactaagtgtaatactcagagctttaagaatagagcaaacaaggttctcactcttaaaaagtgcctgaggattttataaagactgcaactgaagagaagaaaaggcattcttacctgagccctcgatggcagtatttccttcggaactgaaatacattctgaaccactttttccaccagcttgaatggctgctctatcttgggctgtatcaagggagtgaagtgcaccacgcccacgtccaccttcgttgtaagcaaacatattatcattctgtggcatgatatgtggcatagtgtgatcaatcaactcatccttgtaaaacaggaagatgggctgtcaacagcctgttttcataaacagacctttccacgtacttcggtttcatctctaggcatggaagatggtacattctggattcgcaaatgacatggagaaatcagccggctgcacctgttctct

SEQ ID NO: 366364 - DNA, 339 bp, Homo sapiens
gactgggaatattagactttcttaactgatgagatttcaactttacaagtgttcttaaccacagcattttgggcaaagttgtagactcttgtttccatttccttttacatagggacagaaaataattccatatgggaactgatccatacgaagtcagaaatagaaggacggccagaaaccatctttcagttgtgttgcaggtatgactgacttccaaagattaaaaccaacagaaataacatagaattatgtctcttaagggaatttatatttagtgccctcctgaattttgatgatatcagggtcatactccccaccctccgaaaaaggcaactgagg

SEQ ID NO: 366365 - DNA, 789 bp, Homo sapiens
ttttctcatctgtaaaatgggatggtttagtctttgagttattgcgggcactaaatgagatgattcacagaaatcacctgtcgtgatccttgctaagtagaaagtgctccagaaatgtcagttgttgttattagtgatacttttcactgatactctgtctcatttcaaaaagaatttgaagtaggagataattttgctgttcttcattctaagggctgggctacagtgggctgttgtgacttattctgaatgtaatgctcctgctagtgggtactggtctggaatcctgagttgaatcttgactccattcattattactgttggatagaatctaaaacaaataacagttatgaaataaatatgatttcatatcttgcagaagcactaaaggcaatggagaaagtagcgagccacatcaatgagatgcagaagatctatgaggattatgggaccgtgtttgaccagctagtagctgagcagagcggaacagagaaggaggtccgtgagacatctgcaccctgggagcctagtgcatgtggtgtggggtctgtaggtgaccttctagataggctgccctgttaggactttcctggaggagaaaatgcctaagatttttcttgataacaatgtgtctaatgaactacacaatttacatatagacatatcataaaattcattacactggtttaaaatataaccttatgtcacgttcacattgtctggaacatccatggagggtgagagctggcagagggtggggtggagaaaggacatgggaactggcatgtg

SEQ ID NO: 366366 - DNA, 834 bp, Homo sapiens
gttgattttcttcttggtcttccctcgttgttcggtgtcgtgtatgctgtgctgtgtgtgtcatgttgtgcgtctctgcgtgtgttctagtcctccagcgcgtgtgtgtctgggttgtgtttgttttcactgcgccgggtgcgtattttcggctcctggactccctgtgtagtccgtatgcctccgacgccttctgggttggttccaagcccgccgtgtcccgccggcgtttttttttgggggaaacccggcccctgtcctggcccggggtttcccttgggaccggctggggcccgggttgcagtaacaacggggcccgccccccacgcgaggtgtttagaaaacctttctgggccccaggcgccccacaattttttttttttgtactgtatcttatttgatgatatttattttctctgccaagctgtatagtaaaaggaaaataagtcacatctggtcattggcatttgtatcgtcattctgtaaagacaaaagagtacctatataagaagctccacgtagtgcaaatcgacatctggtaggctgctcgcccccaggcagcagctagagtctgtaattctctgcgtcatcctcttctttttcttcatttttgctttttcttcgcttgagttcttctcatccacctgtcagcctcaagtccaggaggaaattctgtgatagctgcttcgctgcttgcagtcttaacaacttaatgatttctcgaatcgtgggcaacggagggagacggcaagtgctgagttttccggaggcagccatgatacgcggcaagcaccatccaaccctacctcacccaggaccttcaccgccgctccg

SEQ ID NO: 366367 - DNA, 3648 bp, Homo sapiens
agggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggcctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgctgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaacttgtccaaaaaaaaaaaaaaaaaaaaaaaaaaaaaaaaaaaaaaaaaaaaaaaaaaagggggggccccccaaaaatccccacgggggggccccaaaatatacgcgcgcgcaacccacagatttttgtggtgaaaaaggggggccccaataaaggggagcgagcataatataaagcagcagggcagaaggggcgcagcgagtataaaaacaaggggcggagggggaaaacaggggacaaacgtggggaccacttgtggggagagaggaaccacataatacgcgcggggggggggacaaacaatgtgggcggacaacacacacccacaacgcgaggaattataaagggcctccggggggaaaataataaaagatttagaggggatcaaagaggggc

SEQ ID NO: 366368 - DNA, 670 bp, Homo sapiens
gatcccggtgccagggaccctgcccagttccaggcgtcgcctaacccagaaacgactgggcgccgcgtcctggaaaggccccagcgcacggacatctgaggagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaa

SEQ ID NO: 366369 - DNA, 818 bp, Homo sapiens
tcccgccaacaattagaatccttttctaatccccaaattgaacctttgaatgaagggctcggtttttccttttcttcccccttgtcggccctcaaaacccaatcattccttttaattaatttaattttttttagcccaagtttggctcttgttgcccagcttgaagtccaatggcgtaatctcggctcattgcacttccacctccaaggtcaaagtgattctcctgcccaagcctccccggtagctgggattacctcgtgcgatttccggcacgagcccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaa

SEQ ID NO: 366370 - DNA, 1216 bp, Homo sapiens
  misc_feature (1019)..(1019): n is a, c, g, or t
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaagaacaaaaaacaaaaaaaaanacaagaaaaaacccggaggcgcatatattcagaccggcggcggacaaaagcgggactaacaactggcgcactgggtcaaacggggtccccagaccccgcgctttttgctccaacggtggaaaccgccgcggcccatataggagggctaaaatcgaaacgccggtaccgataaaccgcgcagcacgacgcccagagag

SEQ ID NO: 366371 - DNA, 1737 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaacatgacttcttaccttctattatctctcctgggcatctggggccaccatgggcagcagggctggtggataagaccgtagggaacctggagggggatgatttagactgctcagatctggggctgggagactcagcctggaggctctgctctccacacccatctgcaggcctgtgggaaggtgtgagcagctggtccagctggggccttcctgcagactgctgacctgaggctcctgtcctcagccccaaaatgggaccagacctctgtactcctcctgaagtctactccctccatgactggctgtgcagcctgccacgccactctccccttttccccactgtagagtggaggcaggggttgcctgtgtccctttgggggttggtcgctggttttccagaagcagggtccccagtctgcccctcctcctccccagggttgcaagcttcgactccctccctttggcaagactcaaaccgtcctcccagctgccccatcaccccttcctggcagtagcaccacttttcataacctttccagcccaggggtccccaggctgggaggacagctggggggatgaatggcaggtaaggcttcctgtgtcttctctcctgttgcaactgtgccacctgcacacttacacactcatggacacaccatgcacatacacacatccacccgcatctagtcacgattcatcacattcacacacatatacaatcataccatttacacacagtta

SEQ ID NO: 366372 - DNA, 1163 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgttcgcttggcgaacaatgcggggggtcccagggtcacccgccacataccagacaaaaatacacacaacgtgtgtacctctttgcaatacttgcaaatattgccactgttgcttggacttagaagaagaaaatccccgtgacttcttcctcatcaccttgatggctttattctcaccttgtggggcatgtatgtatatatggcttcatggccgactgcaatctgagtcctgggaactggcctgcgg

SEQ ID NO: 366373 - DNA, 1017 bp, Homo sapiens
  misc_feature (941)..(941): n is a, c, g, or t
  misc_feature (959)..(959): n is a, c, g, or t
  misc_feature (962)..(962): n is a, c, g, or t
  misc_feature (966)..(966): n is a, c, g, or t
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataangttcacttctttctattncantccncgtcaaggtattgaaattaataagagctttcccctctcttttcgttgttcg

SEQ ID NO: 366374 - DNA, 467 bp, Homo sapiens
tacctattccactgtgtgctccacctgtgtgctcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaa

SEQ ID NO: 366375 - DNA, 876 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatctcactctgttgccctggctggagtgcagtagcacgatcatggctcaccgcagtctcgactttcctgggctcaggtgagtctcccacctcagccttctaagtagctgggactacaggtgcgcatcaccatgactg

SEQ ID NO: 366376 - DNA, 1198 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaaaaacaaaaaaaaaaaaaaacttttggggcggcccgggccccgaaaaagttttaaaccctcgctttgggggcggggccccatggtatggaattgtggccaagcggtcccaaggacacccgggccgcttgtgtgggggttttctcccccataaaaaaaaaggcccgggggacacaccgcagcgtctgcacacaatcccgagagggggttcgcgaggccaagaggggtcctacacgggatcccagggaaggaattaaatacccggagagtggtcgtgacgaggcagctgcacacactcatcacgatcaccaccactccaacaacctcagaacaacatcgcaacggcgacgacacaggcacacaagacacacagcaac

SEQ ID NO: 366377 - DNA, 799 bp, Homo sapiens
agctgtttccgttcctctgcccgccatgccgttcctggagctggacacgaatttgcccgccaaccgagtgcccgcggggctggagaaacgactctgcgccgccgctgcctccatcctgggcaaacctgcggaccggtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttgg

SEQ ID NO: 366378 - DNA, 998 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaa

SEQ ID NO: 366379 - DNA, 1255 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaacaaaataaaaaagtattaaggcgaagattaaaaaaattttgcattacataatttacacgaaagcaatgctatcacctcccctgtgtggacttgggagaggactgggccattctccttagagagaagtggggtggcttttaggatggcaagggacttcctgtaacaacgcatctcatatttggaatgactattaaaaaaacaacaatgtgcaatcaaagtcctcggccacattgtgaactttggggatgtagctctga

SEQ ID NO: 366380 - DNA, 1418 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaaaaaaaaaaaaaagggaaaaaaaaaaaaaaaaaaaaaaaaaaaatttggggggggggcgggagccttaggaaaaaagcgttgttaaaaaccactgctggtgggggagccgggcggcgcccgacgtagagtagtaacaggaccaccgggggcgaccaacgagcgcgtggctaccccaagaggagcaacctcgtggggaccagcgagcaaagcgggcgcgggtggagtttctctccccccgcatattaaaaacagacagcgccgcggggggaagccacccgagggcggtgtcttagaacacaacccccaggagggcgggctcggaggagcggaacaacgagggggagactacataccaacagaggaggtaccacagggagaggctcaggtatataaaaattcggccccgggcgcggggggat

SEQ ID NO: 366381 - DNA, 988 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcccactcttgtggggaaatgatggtgttgttagtcagtaaatgaaataaggccagagagcttcgtcattc

SEQ ID NO: 366382 - DNA, 1238 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccgggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaa

SEQ ID NO: 366383 - DNA, 933 bp, Homo sapiens
taagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaggccccctgaccccttaggttcctgctgttaggaccatcttcaaagtgcgagcaggattgaatgaatttctggctctgctcctcagtgtgtaagtctgtgaaccgggaaggctctcttttaaca

SEQ ID NO: 366384 - DNA, 568 bp, Homo sapiens
ccatatatggtactcgctcgctggtctcagccatgagctttgtgggcgcccggagaccagctttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaattgtaagtggatgaataaatataataactgattccattgatactcttagaccatcctttggactttctgcttttggacattttacagtttaaaatttatttatcatctatcgatgtttcccaaagaaggactcaaagtacacattgtcaaagatctcatggatctaattaaggacagggaacaggtacagaatcatacattgtctctacacagaggggataatttctgaaggaaagaagaaagtaaattccttaatcacccttatgattataactacacaattgaatttgtttacttcatcagctttgggaataaagtaaggtcctacacttttcaatttttcaagagaaaat

SEQ ID NO: 366385 - DNA, 251 bp, Homo sapiens
ccatatatggtactcgctcgctggtctcagccatgagctttgtgggcgcccggagaccagctttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaattgtaagtggatgaataaatataataactgattcca

SEQ ID NO: 366386 - DNA, 248 bp, Homo sapiens
  misc_feature (41)..(41): n is a, c, g, or t
tcacagcaaatactcaaacgactactacgtatacggccaanaattgtgcaaaacagactttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaattgtaagtggatgaataaatataataactgattcca

SEQ ID NO: 366387 - DNA, 3589 bp, Homo sapiens
actcgtgcccaccgctccgcgcgccagcagagacaggcctctagctttacatcacctttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaatttctttcagatccctggaggcctctcccagggcctgtggtgtggagagttggacttgaccctactgtaagagacccaacttccaaagactgcatcagatgaaaggctctccatatagactacagacttgtcagctggttaaggaggcaaacagaacagtctgctacaaactccagtccatgtatctgtgctgaaaataaaaggagtcttcaggaatcaaagaagaaaatatttttataaagaaattttattgcataattcttgtatacaataaacataggaaaagggtttttaatgaaaattcatgtcatttttcaaaagtgttgaactgtctggagaaaaattattacaaagctatctaaggcaaaaataatatttaaccatctaaacaaaagataatcccctttaccatttgttttgtatttaaagcaagacattttaaacacaagtaatacggagaagttttcaaattgctacgtcatttgcattaagaatttaaatgcatctaagaagtgaagagtttaaacacatgggaatgttctctagtaacagatattgctgctttcttcagatccattctgcttgaatgtaaggctatactttttgcacaccaacagaattctgcatcttctaatggtacagtaagagctggagtgcagagagggaaagtcccatgcacttcctatgttaaatggcataactcccacagatcacatacaccttgccatattgactcagttcattgcactccatatcctgcaaaaataaatctagtgcttgacagctgacattattgctcactgacgttttagtaatatatttctttcacataagacagaaatatactgaaatttgataccacttaaacccaaaagcaatctggaattaaaccacatgcatacaccccactttttttcaatagatgttgcatttttcttaaagtcgatcctggaaaatgtggtagaagaaaaactggctttccttgaaacaaagactaaggattagaaaaagaggggcttttttttgagtgaaatgttaagccctacgatataaatgaaggaacaatgacaatccagtctctgtggagagggaagaggcctctcactgatcctccttgtctacctcaacactgtggcccgcgtcccacggaccccaggggaggctatcctacagagctggagcagccgagaggtgctgtgtgtgcctctgaaggatgggctggaggctgtggcaaagccctgagagacctatttctttggccaccccaacgtggaatcctggggtcactgggaaatactagggctttctctgtgagattgggaaagacttctaggatggtctggacgctgatggctgaggtctggtcttaaattttacacgtcatttctagagagacgtgaagcctacgaattccagagtgaacccagggcctggggtgaaatgtcttggaacctgagggaacatctggatgctcagatagaaacctcttatctgagcatccagataagaccagagctcatctggaatcaagtgtacatgactataaagagtccaccgggatgtcaggcttcttagagaggtgcttgtagagagagacatgtaggaatgtggacatggccacactgacgctgtttgtcacagattttcattctaatttcttgttgtttctttaaaattgtcaaatgtccctctttcttttttttctcttagtgcttacaaggaaagctgtcagtcttcataaactttcaaagagttacaaaaatacgtattttttaagctacaattcaagattagcatccaaacctacaaacatgatgtacattcgtcacacaccatacaaccttcacacctggctacagcaatgttgacttacatcaccattgtttatacttgtgaaaactttattgtgcacagtgacatccattccgccagacttaatgttataaagcagctgagcagagcttctcaaagtaaaactagccgtgttgctacaaagggaaattctggctcttggcccaactgtttccataccaatcagctaagtcagcctcctctctgcttctttccatttcaaatgcctgggctttggcctttgaggcaattagaaccagatcagtttaattttacaacactgatctcaactgtatagcaatatagtgaatttgccctgagagtatcaatacattttacaaatattatgagtcccagtttatgcatgaagaaataggcacagagaggctacatggcttgtcctttgtcacacagaagattatgttgagtatgaaacttgagcttccgttttagctttccatgtgaatgcccatgtctctccagaggtcacctggagctctgtgcacaagggccaccccacttggattctgtttgttacttgtactgccctgtcagtttttctgcccagcactgaatttttcagtacccaagacttcatccttgatcttctctgctctctctcattcctgctgccttgatgaagtgtgttgcccctaatattttattttacacagtggaatttgtgcccttccagctgcagctgcttttaggtgtggagagaaggacttataaaaaggcgatggacaggcgttcttctttttgaattttagaccaagtggggctcaatattttacagttgtcttacatttgaatgctgctttctttttcttttcttttttgacaggatctcactctgttcaggctggagtgcagtggtatgagctcagctcactgcaacctccgcctcccaagttcaagcgattctcctgactgagcctcaggagtagctgggactacatgcatgcgccaccatgcccagctagttcttatattgttattattattattttttgagatggagtgtcacattgtcatgtaggctggagtgcagtggcatgatctcggctaactgcaagctccgccttccgggttcacgccattctcctgcctcagcctcctgagtagctgggactacaggtgcccaccaccacgcctggctaatttttcgtatttttagtagagacggggtttcaccatgttagccaggatggtctccatctcctgacctcgtgatccacccgccttggcctcccaaagtgctgggatcacaggcgtgagccattgcactgggcctccaatgctttcgatggaaaataaaataaaataaaggcctaacagtgtggtaatgtttacttctctgccacaacactcagtatgcccctttggatctggcaacaatttaacataaggaaagactttagaccttcacaccctttcagtgagaaaaaaaaaaatgaccttagctcaaactttccacaaagctgaacagtctcattaaaacatcactccaaccttatcttaggtgggc

SEQ ID NO: 366388 - DNA, 863 bp, Homo sapiens
gcagccatttggaggtatgaagagatcttggaaatagaggccatgtgtgttgaaacaagaccgaacaactccaagttcctgaagacttcatttcaccaacccagaacctccttgatcatcacagtgttcaaatggtttccagcaacattcctaccacctactttgctgacacaaaggtgcataaacagaagtcctatgtggtcgaaccattttacattttcaccagcaatgaaggagggttcctgttgctctaccatttggtactgtcagcgttttggatattagccgtcctaatagcctttgcatggatgattgtctgtcctctgttgggccccttctgaagagttggagttggctttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaattgtaagtggatgaataaatataataactgattccattgatactcttagaccatcctttggactttctgcttttggacattttacagtttaaaatttatttatcatctatcgatgtttcccaaagaaggactcaaagtacacattgtcaaagatctcatggatctaattaaggacagggaacaggtacagaatcatacattgtctctacacagaggggataatttctgaaggaaagaagaaagtaaattccttaatcacccttatgattataactacacaattgaatttgtttacttcatcagctttgggaataaagtaaggtcctacacttttcaatttttcaagagaaaat

SEQ ID NO: 366389 - DNA, 541 bp, Homo sapiens
  misc_feature (507)..(509): n is a, c, g, or t
  misc_feature (515)..(515): n is a, c, g, or t
actcgtgcccaccgctccgcgcgccagcagagacaggcctctagctttacatcacctttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaatttctttcagatccctggaggcctctcccagggcctgtggtgtggagagttggacttgaccctactgtaagagacccaacttccaaagactgcatcagatgaaaggctctccatatagactacagacttgtcagctggttaaggaggcaaacagaacagtctgctacaaactccagtccatgtatctgtgctgaaaataaaaggagtcttcaggaatcaaagaagaaaatatttttataaagaaattttattgcataattcttgtatacaataaacacggatgcggccgaaattttnnntttttnttcataccccacccccgcctccatct

SEQ ID NO: 366390 - DNA, 572 bp, Homo sapiens
gctgtaggcagaagtgtcttgcagcagctcctgtaaatcttaaaagacagctggtgcgtgtcttttttcctttttttttcccttcccccttcctgctgcgctgaatatggatatggtgagtgaatctagagcagccatttggaggtatgaagagatcttggaaatagaggccatgtgtgttgaaacaagaccgaacaactccaagttcctgaagacttcatttcaccaacccagaacctccttgatcatcacaggtgaacttattcctaaagcaaacactctcattttccttccttctctactttacaaccatgctgaactgcttgttattccttgaactgatcacacagttccgtgcttctgtgccttacctcttgctgctcctccaccttatgctttgtctttctagcaaattctttcttattaagatctaccttgattgcgccaccgcactccagcctgggcgacagactgagactccatctcaaaaaaaaaaacaacaacaatcctacctctagggtttccagctttgagaagactactcactcacagccaggcaaatttggtgattc

SEQ ID NO: 366391 - DNA, 799 bp, Homo sapiens
gcagccatttggaggtatgaagagatcttggaaatagaggccatgtgtgttgaaacaagaccgaacaactccaagttcctgaagacttcatttcaccaacccagaacctccttgatcatcacagtggtcgaaccattttacattttcaccagcaatgaaggagggttcctgttgctctaccatttggtactgtcagcgttttggatattagccgtcctaatagaaaagagtgagtaactagtggcctttagatgagccaaccgcaagcctggactcatctttgacatctcctgcttccctccataatgaccgtcgttgctcctcttgcccaagcctttgcatggatgattgtctgtcctctgttgggccccttctgaagagttggagttggttgcaaactatagaaaccatttgggctggtttgagcataaaaggaaattactgggagttattaggtgctcggtgattcattgggaggtctggcaaaaaagaagctcaaggctaagctcataggaacacagcccggcatctcacacagaagtggcttgatgaggattctactgcctccacagctcctgccatcatcttcatctgcaccatagatgctcagaacccagtctgtgtctgcatgttgctgacttccaaatgagagcttcatgagagtgtatttggttggtagaacataggtcccagaccttctccctgggagctggaagagatgctgggaaattctgccctggaaaaataaaactcacaatgtgggaaacaaagaaaatgtacagcaggggtttaacagaat

SEQ ID NO: 366392 - DNA, 627 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctagtctctaacttctgctcttcccagccgctcgctattggcgtcggcgtcaccggttgaaggcctaccgttctgggcaagggaggtgacgctggcgcgcgaagattcgccgcttcagccttcttgcttgcagcccctctgatgcctgtatggcgtgatagcctgagggcttgcgggccggggctcccgtgtgtgccccctgctgaaggcgggacatgccctgtatgcccgggagttgggcgcctgccgcaccgtgttttcccacggcagtccggctttggcaggtaccggtgggcggtggggcccttttccccagagggcacgggccaaacctttatccccggccggtgaagttgcgacgtgtgccaacagggggcgttggcaccttttggggctctttgggcctcatttcttttaccccagaaggtagtaaccgcgagcgcgcaacaatttttgtatcaccattgtggcggccctattggttctccctt

SEQ ID NO: 366393 - DNA, 4452 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgagcgcgcatttcccgtctcgggtgcccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgtactgtgatttctggtctcatttctttaaaaccttactcttatttttcttttaaggctcttttttctccttaaggaaggtaatattttctaggttagataggactatcagggtttgtgaacattatgcatttaatgttatgggtactttacacacaagttagatggaatttttagagtgaaagaattaagtaggatttaattgggtgctttgtaaatagtcaactgtgtgtataacgtggtctgtttgatttttaaaaggaaaggatttgtttcagattatacaagaataaaagtattatagacccaagggacttcttatgaggtcaaattcagatatttatatgaatatgaaataccatggtccctagtagtcagttgaagtggcaatgtctaaacagaaatgaacaaaactaatgctagcaggttaaaatcaatcaaaatgtttaaaaattgattctgtcctcagcatgttatttcctcagctctgataatttactggtcttgagtattttgagaatttgatgttgaacgttataaagtcaaagaactgcttgtttagatgaggtttatttttatttttgatattattcattcttgtcacacatcaagaagaaaacactagagtgctgctggaattccaaatctgaagaattctaacgactgcattctttgttattaaaaagggcacaatccttcctttttatttggcagtttaatttcagtaggaagcatgtcacatgtgcactgttggttagaattatgcatctgtcatgcctgactgctgaaccctacctaagccttttggcgcagtttaaaacttatactggtggactgtgaacctcaaaacaaatgggtatttttgggttttgaggatagatgttactccttaaagtttgtatttggggcatgaaaaactactgaaagaagaaaagtgctacagatactacatttcaaagagttggcattttccctttggccactcaagcagcatttgatgtatctaaagaaacaaagtcattgtttattttttaaaaaattatatgcagttgtacaagatactacattccattgaaatgttggctatgtcctaaccaggcaaccagataacaaaaacattttgagtcttttatctaggtagttctaattattcagctacttagtttaacaaaggaaaatatcctgacttctctcatttcatttgtagacttttcattgtataggcacaaccaaagagtcagactggtttaaaactccagaaggaaaaaaagtatcccacacagtggatgttgtttctaagaatgctacaaaatcctgacatctcagacatctcaatgttaaaggaagaaaaaaaataccttttcatttcaaagaactaatatactttgatattgtgtaaaccttactcaagtttattgtcaagctttaactgcctttttagaactttttaaaatttcgagcccacaaatctattgtattagttgccttctataacaataaatcttcactgagcaaaaaaaaag

SEQ ID NO: 366394 - DNA, 3680 bp, Homo sapiens
gtgtcgagcgcgttgtttgcgcctgctaacctttcccttggtgttcggttgctgttccaggccggcgcggtgaacaagcagggcgacagcattctgtgccgctgagccgcgctgtccaggtgagcgcgcatttcccgtctcgggtgcccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgtactgtgatttctggtctcatttctttaaaaccttactcttatttttcttttaaggctcttttttctccttaaggaaggtaatattttctaggttagataggactatcagggtttgtgaacattatgcatttaatgttatgggtactttacacacaagttagatggaatttttagagtgaaagaattaagtaggatttaattgggtgctttgtaaatagtcaactgtgtgtataacgtggtctgtttgatttttaaaaggaaaggatttgtttcagattatacaagaataaaagtattatagacccaagggacttcttatgaggtcaaattcagatatttatatgaatatgaaataccatggtccctagtagtcagttgaagtggcaatgtctaaacagaaatgaacaaaactaatgctagcaggttaaaatcaatcaaaatgtttaaaaattgattctgtcctcagcatgttatttcctcagctctgataatttactggtcttgagtattttgagaatttgatgttgaacgttataaagtcaaagaactgcttgtttagatgaggtttatttttatttttgatattattcattcttgtcacacatcaagaagaaaacactagagtgctgctggaattccaaatctgaagaattctaacgactgcattctttgttattaaaaagggcacaatccttcctttttatttggcagtttaatttcagtaggaagcatgtcacatgtgcactgttggttagaattatgcatctgtcatgcctgactgctgaaccctacctaagccttttggcgcagtttaaaacttatactggtggactgtgaacctcaaaacaaatgggtatttttgggttttgaggatagatgttactccttaaagtttgtatttggggcatgaaaaactactgaaagaagaaaagtgctacagatactacatttcaaagagttggcattttccctttggccactcaagcagcatttgatgtatctaaagaaacaaagtcattgtttattttttaaaaaattatatgcagttgtacaagatactacattccattgaaatgttggctatgtcctaaccaggcaaccagataacaaaaacattttgagtcttttatctaggtagttctaattattcagctacttagtttaacaaaggaaaatatcctgacttctctcatttcatttgtagacttttcattgtataggcacaaccaaagagtcagactggtttaaaactccagaaggaaaaaaagtatcccacacagtggatgttgtttctaagaatgctacaaaatcctgacatctcagacatctcaatgttaaaggaagaaaaaaaataccttttcatttcaaagaactaatatactttgatattgtgtaaaccttactcaagtttattgtcaagctttaactgcctttttagaactttttaaaatttcgagcccacaaatctattgtattagttgccttctataacaataaatcttcactgagcaaaaaaaaag

SEQ ID NO: 366395 - DNA, 4361 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcacacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgagcgcgcatttcccgtctcgggtgcccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgtactgtgatttctggtctcatttctttaaaaccttactcttatttttcttttaaggctcttttttctccttaaggaaggtaatattttctaggttagataggactatcagggtttgtgaacattatgcatttaatgttatgggtactttacacacaagttagatggaatttttagagtgaaagaattaagtaggatttaattgggtgctttgtaaatagtcaactgtgtgtataacgtggtctgtttgatttttaaaaggaaaggatttgtttcagattatacaagaataaaagtattatagacccaagggacttcttatgaggtcaaattcagatatttatatgaatatgaaataccatggtccctagtagtcagttgaagtggcaatgtctaaacagaaatgaacaaaactaatgctagcaggttaaaatcaatcaaaatgtttaaaaattgattctgtcctcagcatgttatttcctcagctctgataatttactggtcttgagtattttgagaatttgatgttgaacgttataaagtcaaagaactgcttgtttagatgaggtttatttttatttttgatattattcattcttgtcacacatcaagaagaaaacactagagtgctgctggaattccaaatctgaagaattctaacgactgcattctttgttattaaaaagggcacaatccttcctttttatttggcagtttaatttcagtaggaagcatgtcacatgtgcactgttggttagaattatgcatctgtcatgcctgactgctgaaccctacctaagccttttggcgcagtttaaaacttatactggtggactgtgaacctcaaaacaaatgggtatttttgggttttgaggatagatgttactccttaaagtttgtatttggggcatgaaaaactactgaaagaagaaaagtgctacagatactacatttcaaagagttggcattttccctttggccactcaagcagcatttgatgtatctaaagaaacaaagtcattgtttattttttaaaaaattatatgcagttgtacaagatactacattccattgaaatgttggctatgtcctaaccaggcaaccagataacaaaaacattttgagtcttttatctaggtagttctaattattcagctacttagtttaacaaaggaaaatatcctgacttctctcatttcatttgtagacttttcattgtataggcacaaccaaagagtcagactggtttaaaactccagaaggaaaaaaagtatcccacacagtggatgttgtttctaagaatgctacaaaatcctgacatctcagacatctcaatgttaaaggaagaaaaaaaataccttttcatttcaaagaactaatatactttgatattgtgtaaaccttactcaagtttattgtcaagctttaactgcctttttagaactttttaaaatttcgagcccacaaatctattgtattagttgccttctataacaataaatcttcactgagcaaaaaaaaag

SEQ ID NO: 366396 - DNA, 1448 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggatacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaat

SEQ ID NO: 366397 - DNA, 3885 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgtactgtgatttctggtctcatttctttaaaaccttactcttatttttcttttaaggctcttttttctccttaaggaaggtaatattttctaggttagataggactatcagggtttgtgaacattatgcatttaatgttatgggtactttacacacaagttagatggaatttttagagtgaaagaattaagtaggatttaattgggtgctttgtaaatagtcaactgtgtgtataacgtggtctgtttgatttttaaaaggaaaggatttgtttcagattatacaagaataaaagtattatagacccaagggacttcttatgaggtcaaattcagatatttatatgaatatgaaataccatggtccctagtagtcagttgaagtggcaatgtctaaacagaaatgaacaaaactaatgctagcaggttaaaatcaatcaaaatgtttaaaaattgattctgtcctcagcatgttatttcctcagctctgataatttactggtcttgagtattttgagaatttgatgttgaacgttataaagtcaaagaactgcttgtttagatgaggtttatttttatttttgatattattcattcttgtcacacatcaagaagaaaacactagagtgctgctggaattccaaatctgaagaattctaacgactgcattctttgttattaaaaagggcacaatccttcctttttatttggcagtttaatttcagtaggaagcatgtcacatgtgcactgttggttagaattatgcatctgtcatgcctgactgctgaaccctacctaagccttttggcgcagtttaaaacttatactggtggactgtgaacctcaaaacaaatgggtatttttgggttttgaggatagatgttactccttaaagtttgtatttggggcatgaaaaactactgaaagaagaaaagtgctacagatactacatttcaaagagttggcattttccctttggccactcaagcagcatttgatgtatctaaagaaacaaagtcattgtttattttttaaaaaattatatgcagttgtacaagatactacattccattgaaatgttggctatgtcctaaccaggcaaccagataacaaaaacattttgagtcttttatctaggtagttctaattattcagctacttagtttaacaaaggaaaatatcctgacttctctcatttcatttgtagacttttcattgtataggcacaaccaaagagtcagactggtttaaaactccagaaggaaaaaaagtatcccacacagtggatgttgtttctaagaatgctacaaaatcctgacatctcagacatctcaatgttaaaggaagaaaaaaaataccttttcatttcaaagaactaatatactttgatattgtgtaaaccttactcaagtttattgtcaagctttaactgcctttttagaactttttaaaatttcgagcccacaaatctattgtattagttgccttctataacaataaatcttcactgagcaaaaaaaaag

SEQ ID NO: 366398 - DNA, 2558 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaaagaaaattttttttgtctgtacctggaatttaggggtccatatttttaaaaaaccaacactataatttaccttattagaggttttttttttcccttaagggaggaggggatattctgggggttatgaggaaaatattggggggtggggacatatctcccttctaataagggatggggggatttttcaccacaattaacagggatatatttta

SEQ ID NO: 366399 - DNA, 1507 bp, Homo sapiens
gagcgggagagcgtagtggaggaggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggccggcgcggtgaacaagcagggcgacagcattctgtgccgctgagccgcgctgtccaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaat

SEQ ID NO: 366400 - DNA, 305 bp, Homo sapiens
ggaaagacaagatcagcacaaaaaattgtatgagtcaagtaaaggacccatttaaagggtttgaacttgcttgaaattgcttgaaaaaatactatggttattaagtgctagattgaatgacatagtcaacactgttcaatagaaatgtaatacaagttacatatgtagtttaaaattttctaggagccacattaaaatacgttaaaagaaacaggtgaaattattttaataatatttaatctagtatatcaaaaatattatttcaatatgctctcaacataaacaaatgaaatattttacttttt

SEQ ID NO: 366401 - DNA, 1206 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaattt

SEQ ID NO: 366402 - DNA, 2067 bp, Homo sapiens
cttgaataaacagagtacccttggttttcctactttatagatgggttttacttaccagcagaccattttgtactttatttgagtctattcccaggactgcataaatttctccccacataagaagacccacaagtccacttatctgtggaggtgagtggaccatgtaccatcctagagcttcttccatgttacacaaggacacaagatttggatcactggtattcacaaagagcccttgttaatagtatgatcccaacccattctcactggttgcagaggaatgtccctttatgttatccttatgttgcagaactcggaaacaatagccacttcatgaaagcaaatgctcgcgtgcagctaacagtgcattggatttccactcacattatcaggacatttgttttctagactttatcagtggaaccttaaagaaactttgatttcaccttagatttttatcggttccaagcctacaggtttattagcaacctgaacttcagcagcttggtatataggccatcatcctcatttacactatgaaatgtttgatatttgttcaatatccctgtgtctgtgccttactagcagaaactagagcatgcaggtactggcattttcttggtttgcatatatgcagtagctcattaatactctctggcagcaactgaaactggtaagttatcaaagatatccagcgagaagagaaaaaacctgatatgtgagccaagggacgtttgtttagttgttgttgagggtggagggaatttagagaagatttgaaattaatttccaaatcaaatttgagagcaccttgtggtaaatggtagtctatagcatctcccttagtccaacatcctgtaacaaagagatcttcacatgtagccattctgatattttgaactctttgtagttgttttagctttattactaaatttttttccaagatatgtatgcttttcaaatgggaagcatgtgattctatccaaaaagtagcccagtgttaatacagtaatttaagaaactgtccagcagaggtctctgaacttcatggtttaagaagagcatttcaaacaataaatcaaacctgattctttgcatgacagaaatatacttctattgagcatattttccagattggattttagaataactgtatttcacataggttaaactctgcttattcatgtttaaagacgctgaaaacttatgttttcagatttttattcccctaacaggataaaagcctggttaccaccaactttgcactataaaaagaataaatatatatgaaacgtagaagacaaaagcaacaactaatattctactatgccaccagcactacaaaggcattgatgtagtttggctttctttctatgcagccaaaatccataattaaatcaagcaactggctgtattgcttgatttataaagaacatgcatgattggactgcaaacttttctttgtgcaaaagcaggaaataaataaataccaatttgtatgttttgtgttgccagcgatgaaatctacattgctccttcaggagtgcaaaaggaacgaattcaggtatggtaatgggattctttaacctcagtgtcttttcttcttaattactgttttatgaaatggaattaattttaagagaaaacattcattttatcatagcaatttgaataactaatcagcaaacatttattgagtaattattaaatgttttgtaaggtggtagatatcttccatacaaccggtgtatgttttgaaatctcattcaacctatagggggcaaaagtgaatagtgcaatcttaaatcacagtaaagagcaattataactttgcagctttataacactacgatctttatcaggctggtggaataatcagattgatggtctcagatgaaccaaattaattcatatttcctaatagcaaagttattctaatttcaggatttcaagttatgaaactttgtttcaaattttgagaagtcttattctgtgttaatgccagaataataccccaaatctagttaaagcaaacacataattatttaacttctaatgcaaaaaaaa

SEQ ID NO: 366403 - DNA, 710 bp, Homo sapiens
tataattcaatttttaatcttttctatgcttctgattctgaaatatatcatttgccatctccttgtataaatattatgattgtccctgcttcaaggaaacatttatatgatcatgatttctttgttaggttttggtatattttacaaatttccaccacttaggcttaggattagaccaagcctgccacattcccaaggtaccttttgatagagatgtttatacaaggtacacagaataacacgcaacatcctgttcataatttggagtggcttttcagacacaaacagcatgtctaactggttacttgaaaaaattacatgttgtatacatatcaatgcttgatttgttttaatggaaaaaaatggcttgttttgtcttacagatatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgagtgtaaatcagagaacatggggaacaagttaccacccgctaaatgtgaaggtactttatttttattatgtatccattcatgaagaagtattgattggatgagctgttgtttggcaaggctctaggaatgttgatagaggaagaagacacagat

SEQ ID NO: 366404 - DNA, 4081 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaatttaaaaaaaaaaaaaaaaaactcgagactagttctctctctctctcgagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagtttttgttcttttttcctggatctaccctcatggtcgttttcaacatagcgggttagagttcttatactgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattc

SEQ ID NO: 366405 - DNA, 3980 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcagcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaatttaaaaaaaaaaaaaaaaaactcgagactagttctctctctctctcgagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagtttttgttcttttttcctggatctaccctcatggtcgttttcaacatagcgggttagagttcttatactgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattc

SEQ ID NO: 366406 - DNA, 2435 bp, Homo sapiens
cttgaataaacagagtacccttggttttcctactttatagatgggttttacttaccagcagaccattttgtactttatttgagtctattcccaggactgcataaatttctccccacataagaagacccacaagtccacttatctgtggaggtgagtggaccatgtaccatcctagagcttcttccatgttacacaaggacacaagatttggatcactggtattcacaaagagcccttgttaatagtatgatcccaacccattctcactggttgcagaggaatgtccctttatgttatccttatgttgcagaactcggaaacaatagccacttcatgaaagcaaatgctcgcgtgcagctaacagtgcattggatttccactcacattatcaggacatttgttttctagactttatcagtggaaccttaaagaaactttgatttcaccttagatttttatcggttccaagcctacaggtttattagcaacctgaacttcagcagcttggtatataggccatcatcctcatttacactatgaaatgtttgatatttgttcaatatccctgtgtctgtgccttactagcagaaactagagcatgcaggtactggcattttcttggtttgcatatatgcagtagctcattaatactctctggcagcaactgaaactggtaagttatcaaagatatccagcgagaagagaaaaaacctgatatgtgagccaagggacgtttgtttagttgttgttgagggtggagggaatttagagaagatttgaaattaatttccaaatcaaatttgagagcaccttgtggtaaatggtagtctatagcatctcccttagtccaacatcctgtaacaaagagatcttcacatgtagccattctgatattttgaactctttgtagttgttttagctttattactaaatttttttccaagatatgtatgcttttcaaatgggaagcatgtgattctatccaaaaagtagcccagtgttaatacagtaatttaagaaactgtccagcagaggtctctgaacttcatggtttaagaagagcatttcaaacaataaatcaaacctgattctttgcatgacagaaatatacttctattgagcatattttccagattggattttagaataactgtatttcacataggttaaactctgcttattcatgtttaaagacgctgaaaacttatgttttcagatttttattcccctaacaggataaaagcctggttaccaccaactttgcactataaaaagaataaatatatatgaaacgtagaagacaaaagcaacaactaatattctactatgccaccagcactacaaaggcattgatgtagtttggctttctttctatgcagccaaaatccataattaaatcaagcaactggctgtattgcttgatttataaagaacatgcatgattggactgcaaacttttctttgtgcaaaagcaggaaataaataaataccaatttgtatgttttgtgttgccagcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaattt

SEQ ID NO: 366407 - DNA, 1139 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcagtggcttacatggctatcaaaattgaagctcaaggtcaccagagttttgcaataccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaattt

SEQ ID NO: 366408 - DNA, 1169 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaattt

SEQ ID NO: 366409 - DNA, 1288 bp, Homo sapiens
  misc_feature (1282)..(1284): n is a, c, g, or t
  misc_feature (1286)..(1288): n is a, c, g, or t
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaatttttcctcattgtggaatgagcattctcttgttttaatgttggtgtcagaaaataaatatgaaacattaagtccaaannnannn

SEQ ID NO: 366410 - DNA, 1050 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagttatattaagagataagtaagtatttattaatgaaggcatttttaatggattgattcagaggcaatggctaataggagggccgaatcttaatgggggtggtatcaacaaagggggaggaatactggtggttatagaaaggattgttgacagtggggaaaaccggggggggaaaaagggggc

SEQ ID NO: 366411 - DNA, 1301 bp, Homo sapiens
cgccccgcccccgggctgccctcagcgccgcctgattgcatttgcggcctcgctgccgcatcccaggctaagcgccgcgcgcaaagccgtgcggagattggaggccgcgcgggtccctggtctgggccatgtctggctgtgatgctcgggagggagactgttgttcccggagatgcggcgcgcagtggcttacatggctatcaaaattgaagctcaaggtcaccagagttttgcaataccttcaggaacattctggctttggcgctcacttctctcccaggacaaggagcatccaagatacctgatcccagaactttgcaaacagttttaccatttaggctgggtcactgggactggaggaggaattagcttgaagcatggcgatgaaatctacattgctccttcaggagtgcaaaaggaacgaattcagcctgaagacatgtttgtttgtgatataaatgaaaaggacataagtggaccttcgccatcgaagaagctaaaaaaaagccagtgtactcctcttttcatgaatgcttacacaatgagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaattt

SEQ ID NO: 366412 - DNA, 331 bp, Homo sapiens
gcaaagtggtctccttcagttttaataggatttccctggctgcgttgttgagagatccctgaggaaggcaaaggcagagcagaagaccagtcaagaggctgatgtcataattcaggcaagcagtgatgatggcctagaccagggcagtatcagtggaggtgggaaaaagtggtgtgagtctggatgtattttgaaagaagagtctacatgagagagaaaagactaacgggatctgttcccaagtaactcaactgcattcctgtacaaagctgaagagtcttacagggctgcgtctatagccaggagtacgctcaggcttcagaagaggctc

SEQ ID NO: 366413 - DNA, 360 bp, Homo sapiens
gctcgactaatgataaggtaatggccgggaagccaataaatgtttgttgaatgagttaatgaaagacactattgggcctggcacagtggctcgtgcctgtaatcccagcactttgggaggctgaggcaggtggatcatcttattaatgtaccctggtctttcacatttttatttaactttaaatcaaattgaacaatttcaggaacaacctcccatccctcaaaggaaacaagctgatgcccagaaatattttctgtggagctttatataatttttttttctttccagagacacattttcagctctgccaaaccataatgcttaggctttcgtttggatatagctgaggtgtcttggaag

SEQ ID NO: 366414 - DNA, 1355 bp, Homo sapiens
ctaccatatgtgcagcacaacagtgacatcttaaggccaagtaaccagagctcctttagccagagaaagaacttgaattgggatctgatttcaaagaaatcccattatattatcaagtcgttttcaaatttacaatattcgactggtaaagaaagtgcttctttatgacttcttttgcagtctttgtgaaccttttaatgtgcaatagtaaacattgacattttacatagacatattgtatattaatgcatgcatttcactgcatagtttattgacactacccttgtaaagcttttatggaagaaccaacaagccacagcagtatagcaaaagaggcttaatctttataaattggggccttttctgtctctttgctagcctaggtggctgtatacaaattcgggtgggagggggcaggaaacacctcttcacatttaaggttttctacttgggtgtactctagccaattcaaaacaaattgcttactttaataatacaattttaccattttataaaaaaaatcaaatcacaacatgtttaactgaaatggctgtattgtaattaatattttgagataattgtgattttgagcttaaattatatataaaaaattgtcatttttgtatgtgttaaaaagactactatatcacaattaaaagtactttttagttgaactacatattgatgtaaataaaactgaatgaagacatatttactactttattaacatagatcgtgaatgtacttactggtttttttgcagtatgagaccataacaaccttgaaagctgcttcattttatgtgcaaagaagtcctatgaatctatattttaaatttactgaaccagtgaaattaattactgtcagttaatttgcaaatgcaagctgtattctccagttttattttatgtactgacactaattggtaaaggtgtacaatgtgattagaatgcattttgaagatgctttctgtacagatacaaaatacagggactaaaataatgctgtgcagtgtatagcagagccatttttcggctttggtgtactcaactttttcagtatttaaaaaagtgttttgaataacataaaagtctccttattgtataaataataaaatgtcaccttattgtaaagtgtcttttgtttactatcaaagcagacctcgtagtcagcaacagagatgtaataagaaaaaggcatgtttttgtttttattttttatttttttgagatggaggagtttcactcttacccaaggctggagtacagagtggcgcgatctcagcactctgtcatcctctgcctcctgggttcaagtgattctcctgcctcagcctcccaagatgctgagattac

SEQ ID NO: 366415 - DNA, 627 bp, Homo sapiens
aaagtagagatgttggcatctctaaaatgccaacaaagtttcaaaaagcaaaacatggggaagagattttcatccttgccttaaaaacaaagtttaaataatagcactttctattaataaaatttctatgaatttaactcttggatctttaatttcctaaaagagaacaaatataaatagaaatgccttttttctaccatatttcagttgaaataatggatttgtttaaactacatattcctatatgtcaaataataataaagtaggataaagtcatagttatattaaaattcataattttattaagatctccactttctgaaagggaacacacttatggaacttcatttggatgtggagaagaattagagaatctcaaggcatcaattaaattatgggtggcaatatttaaaatttgaaagctcacagttgttatagacagagatagctacatttgaatccggatttaaccacttcataactgtggaaaaagatggagttgattttctttcttatattcaggtttctaatttctaaagtgggagaaataatattaacacccagtgaggagtcagtcagtttctgatcctgatgcactcgtctgcaagtggtttagagaatttactc

SEQ ID NO: 366416 - DNA, 489 bp, Homo sapiens
gatatgattaaatatgctataattaaaatgttggactcttgaattttgataaactttaaagctagaaagttggctgggcgcagtggctcacacctgtattcccagtgctttgggaggccgagacaggcagatcacaaggtcaggagttcgagaccagcctagtcaatatggtgaaaccatatctctactaaaaatacaaaaattagctgggtgcagtggtgtgaacctttagtcccacctactcgggaggctgagacaggagaatcacttgaacccaggaggcagaggctgcagtgaaccgagatcacaccactacactccagcctgggtgaatcgcttgaacccaggaagcggaggctggaatgagcagagatcgtgccactacactccagcctgggtgaatcgcttgaacccaggaggcggaagttgcagtgagccgagatcgtgccactacactccaccctgggtgacagagcgagactccatctc

SEQ ID NO: 366417 - DNA, 1317 bp, Homo sapiens
ctggactgctccggcggccgcggggcggggcggagcactcggcggagccgctctgcctgcgtccgctcttcccgcagccaagggtgggcgccggtcctaggaggcgcacggttgtaagccagacaaaaagaactggggtgcccggagtgccaggtggcgggcaagcggtgggcttttcggcggggtctttaggatttgcagctccaggaagcgagatgtcgaagccgccacccaaaccagtcaaaccagggcaagttaaagtcttcagagccctgtatacgtttgaacccagaactccagatgaattatactttgaggaaggtgatattatctacattactgacatgagcgataccaattggtggaaaggcacctccaaaggcaggactggactaattccaagcaactatgtggctgagcaggcagaatccattgacaatccattgcatgaagcagcaaaaagaggcaacttgagctggttgagagagtgtttggacaacagagtgggtgttaatggcttagacaaagctggaagcactgccttatactgggcttgccacgggggccacaaagatatagtggaaatgctatttactcaaccaaatattgaactgaaccagcagaacaagttgggagatacagctttgcatgctgctgcctggaagggttatgcagatatcgtccagttgcttctggcaaaaggtgctagaacagacttaagaaacattgagaagaagctggccttcgacatggctaccaatgctgcctgtgcatctctcctgaaaaagaaacagggaacagatgcagttcgaacattaagcaatgccgaggactatctcgatgatgaagactcagattaattcctttctggagctttgagatctaaaacttctgttgcttttgccattccaaaactttgtctttgccagaaaagtgttggtaactataaagaaaattatatatgaacacggcagtgttgcactgtgtttgagtagaacgtgtaaatgaattgttcccacctttggtttgccagtaagtgactggattcttggcacatttgtgttcaccaaagtagaacaagaagatattatttctatttatcaagcaaaaggaattttaagattttttttttctttaaaaacaaattaggatttttttttttttttttttttttagttaaaatgctttacctcaatggttgagatattttgaatggatttttcaagggggggaaatgcttattataataataaaccaaaatacttaacagaaaattgtcagctattctgacaaaaataaacattttgagagacttta

SEQ ID NO: 366418 - DNA, 164 bp, Homo sapiens
aagtcgggccaggatgccatcctctcttttgtgaggcatcagctccaggtgaggcaattacagggttttcaagggggggaaatgcttattataataataaaccaaaatacttaacagaaaattgtcagctattctgacaaaaataaacattttgagagacttta

SEQ ID NO: 366419 - DNA, 1178 bp, Homo sapiens
ggcgacagccaagcgcgcgcctgtacccagtgcgccgctacccgcagctcgctccccgagaggcccacagcccctttccccacgctcctcctgggttagagggatgccagggcaagttaaagtcttcagagccctgtatacgtttgaacccagaactccagatgaattatactttgaggaaggtgatattatctacattactgacatgagcgataccaattggtggaaaggcacctccaaaggcaggactggactaattccaagcaactatgtggctgagcaggcagaatccattgacaatccattgcatgaagcagcaaaaagaggcaacttgagctggttgagagagtgtttggacaacagagtgggtgttaatggcttagacaaagctggaagcactgccttatactgggcttgccacgggggccacaaagatatagtggaaatgctatttactcaaccaaatattgaactgaaccagcagaacaagttgggagatacagctttgcatgctgctgcctggaagggttatgcagatatcgtccagttgcttctggcaaaaggtgctagaacagacttaagaaacattgagaagaagctggccttcgacatggctaccaatgctgcctgtgcatctctcctgaaaaagaaacagggaacagatgcagttcgaacattaagcaatgccgaggactatctcgatgatgaagactcagattaattcctttctggagctttgagatctaaaacttctgttgcttttgccattccaaaactttgtctttgccagaaaagtgttggtaactataaagaaaattatatatgaacacggcagtgttgcactgtgtttgagtagaacgtgtaaatgaattgttcccacctttggtttgccagtaagtgactggattcttggcacatttgtgttcaccaaagtagaacaagaagatattatttctatttatcaagcaaaaggaattttaagattttttttttctttaaaaacaaattaggatttttttttttttttttttttttagttaaaatgctttacctcaatggttgagatattttgaatggatttttcaagggggggaaatgcttattataataataaaccaaaatacttaacagaaaattgtcagctattctgacaaaaataaacattttgagagacttta

SEQ ID NO: 366420 - DNA, 624 bp, Homo sapiens
ctggactgctccggcggccgcggggcggggcggagcactcggcggagccgctctgcctgcgtccgctcttcccgcagccaagggtgggcgccggtcctaggaggcgcacggttgtaagccagacaaaaagaactggggtgcccggagtgccaggtggcgggcaagcggtgggcttttcggcggggtctttaggatttgcagctccaggaagcgagatgtcgaagccgccacccaaaccagtcaaaccagggcaagttaaagtcttcagagccctgtatacgtttgaacccagaactccagatgaattatactttgaggaaggtgatattatctacattactgacatgagcgataccaattggtggaaaggcacctccaaaggcaggactggactaattccaagcaactatgtggctgagcaggcagaatccattgacaatccattgcatgaagcagcaaaaagaggcaacttgagctggttgagagagtgtttggacaacagagtgggtgttaatggcttagacaaagctggaagcactgccttatactgggcttgccacgggggccacaaaggtattacattttgtttgttatatgtttctatgctgctgaaaatgtgtttca

SEQ ID NO: 366421 - DNA, 587 bp, Homo sapiens
ctggactgctccggcggccgcggggcggggcggagcactcggcggagccgctctgcctgcgtccgctcttcccgcagccaagggtgggcgccggtcctaggaggcgcacggttgtaagccagacaaaaagaactggggtgcccggagtgccaggtggcgggcaagcggtgggcttttcggcggggtctttaggatttgcagctccaggaagcgagatgtcgaagccgccacccaaaccagtcaaaccagggcaagttaaagtcttcagagccctgtatacgtttgaacccagaactccagatgaattatactttgaggaaggtgatattatctacattactgacatgagcgataccaattggtggaaaggcacctccaaaggcaggactggactaattccaagcaactatgtggctgagcaggcagaatccattgacaatccattgcatgaagcagcaaaaagaggcaacttgagctggttgagagagtgtttggacaacagagtgggtgttaatggcttagacaaagctgtatacgtttgaacccagaactccagatgaattatactttgaggaaggcgatattat

SEQ ID NO: 366422 - DNA, 235 bp, Homo sapiens
aattcaatccttttttgtccattaccctactgccttaccacccaattagcgctatataaatattagttgactgaatgataagttgtcaaaatttttatcagttggtacccctttgttagagttgcgtgttttgcttttgacccagctacaaagagcatgaaactaatttgcaatgcataatttttttaagaaatgctttttactgtagagaaataaaagttgaaaactaatgcaa

SEQ ID NO: 366423 - DNA, 438 bp, Homo sapiens
gaattcaggagatggacagggcatgtagccacattggttatggaggggatgggtaaaggagatagaggtagagagagtgatgctgcagttttgacttaagtaactcagtgagggctgaagccatgaactgtggtaaggagatggtggttaacaacgtggactctggataaaccctgtatgcgttcaaattctagttctaccattctgtctatatgactgaacgaattatctactcactctaacctcttactgagctgcaaaattgggggataaaagcaacagtgtatctctggagctgtgatgattaataatagcagtgatagtggtgttattttgaatagggtttatgggaaatatgagtttgattttggagttgcctcataaatatccaagaggaggcaccaagcaggcagttatatgtatggatttggagaatta

SEQ ID NO: 366424 - DNA, 696 bp, Homo sapiens
gagctccaggtcttctcaatgaatgaaagaatggatgaatgtctttctcctaagtcatgtatgacctgtagaggcttccaggtcttctaatcttatccagtgtgcaacactgtcctacaaagcacagtggtaacttctaactttcctttctccccaggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366425 - DNA, 2516 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366426 - DNA, 924 bp, Homo sapiens
  misc_feature (43)..(43): n is a, c, g, or t
atagaaaagtttgtaaaaaaagcaggtggtacggtcggaattnccgggatgatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366427 - DNA, 1345 bp, Homo sapiens
ctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctgagtagctagggctacaggtgcacgcccccatgcctggctaattgaaatatatatatatatatatatactgtagagatgaggtctccaacatctttctgtggcagagctgggattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccattgggtctccaggccccaggggtcttctggaggggtcttgcaaccatttcttattgcctccttctcagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtaggtgcaggggaggagcaggtgagaagccacctgtattagtccatgctcacactgctaataaaaacatacctgagactgggtaatttacaaaggaagaaggtttaattgactcacagttcagcatggattgagaggcctcaggaaacttacagtcatggtggaaagcgaaggccaagcaagtcaccttcttcacaaggcggcaggaaggagaagtgagtgccagcagggcaattgccagatgcttataaaatcatcagatcagccgggcgcggtggctcatgcctgtaatcccagcactttgggaggctgaggcgggcggatcacaaggtcaggagattgagaccatcctggctaacacagtgaaaccccatctctactaaaaatacaa

SEQ ID NO: 366428 - DNA, 536 bp, Homo sapiens
tgtggtgggggcgtgtgtcctgcaaacagtctttccccatctcacaccctggggactcgcagcccttcacttgagtcacagtataggctgcagcccgtcacttccttcaaagggactgtggattccttcagatttcctgtctaattcctgaatcacttcttgaaaaaaaagttcacagtgtgaatctctacacagtgttttgtccttccaagtgggaggggtatgccagcaatgcctctaatccaacatgtttgctgtcctgctctttcatagtaggacagctaggactttccagaagtgcccccataaatctgcatgggccagagcttgacctccctctagctgcaagggaggctgggaaatatttgcccttcctgcctgtgggctgagaaacgttggcatggaagggagcttgaaatggccttggggtagccagtctacagtgcccggctggctccacccatagaaggttcctgaggacaaatctgtcttgtttactgctctattccaacagtcagaagagtgccgggtgccca

SEQ ID NO: 366429 - DNA, 1158 bp, Homo sapiens
tcagtctcctgaactcaccttggctgtctcggcttctttccctaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366430 - DNA, 1644 bp, Homo sapiens
ctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctgagtagctagggctacaggtgcacgcccccatgcctggctaattgaaatatatatatatatatatatactgtagagatgaggtctccaacatctttctgtggcagagctgggattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccattgggtctccaggccccaggggtcttctggaggggtcttgcaaccatttcttattgcctccttctcagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366431 - DNA, 573 bp, Homo sapiens
gactttgtctctcctttccgagtcaatggtgggttacactgatcttgttccactgattactctctctgccgagtccgctgcattaatgcagcggactcggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366432 - DNA, 1535 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggatggctccaccaggagttgttctgtggattaaattaatacttgttaataca

SEQ ID NO: 366433 - DNA, 1716 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggtaccatgtgtagtgtgataagtgtcatcaacagtaagtgccaccaaccttctcccccctcttgctcttccccacccctgtgggccagtcctgcaggggacatgaccagatgtcccactggtacagtttggatatttgttcccttccacatctcatgttggaatgtaatcccccaatgtaaattagttcaaccattgtaggagacagtgtggaattcctcaaggatctagatccagaaatactatttggcccagcaatcccattactgggtatatgcccaaaggaatgtaaatcattctgttagaaagatacaggcacatgtatgttca

SEQ ID NO: 366434 - DNA, 650 bp, Homo sapiens
ccaacagccagaagagtgccgggtgcccactaattgcttcataaatatttatggaatggaagaatgatctttcttcctgctgcagatccctgcagtgctttatgccagtctgctggtgctttgaatatcaagcatgacagtcacgtgatggagaatgtttgaattttattgctcttttcttggcaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366435 - DNA, 361 bp, Homo sapiens
ggtagccagtctacagtgcccggctggctccacccatagaaggttcctgaggacaaatctgtcttgtttactgctctattccaacagtcagaagagtgccgggtgcccactgattgcttcataaatatttatggaatggaagaatgatctttcttcctgctgcagatccctgcagtgctttatgccagtctgctggtgctttgaatatcaaacatgacagtcatgtgatggagaatgtttgaattttattgctattttcttggcaggtttatggagaagggctgttgctaatgctaaaagcattggacaccttatttttggtgagtatttggggaacagaaaggtcaaagcctagagatat

SEQ ID NO: 366436 - DNA, 2473 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366437 - DNA, 2500 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366438 - DNA, 1763 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagcagctgtgtggcctgatccaatgtgcgtaacttctgtgcatgtcggtttcctcagctgtaaaattgggctaacgatggctccaccaggagttgttctgtggattaaattaatacttgttaataca

SEQ ID NO: 366439 - DNA, 1554 bp, Homo sapiens
gctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactga

SEQ ID NO: 366440 - DNA, 346 bp, Homo sapiens
ctcttttaatgctcagaatgtcctaatcaggttgttcagatcacgaaactgaggttcagggaggtgaagtaatgtgtccaagaccacagagctagaaagtggcagaacccacattaaaaccagagactttgtaagcagagtctggcgttgataggtaccgaggtgtctttttttaggagaccacagaaaggtgttctaggacagttttaacatttggtatctttgtagtttttagtctaaaaatctactttgtagggaaagtaagtattaacacttaaatgaggtataagcttatttttagatttttgggactgaaacaataaaaaagcttcttaaaccttatttg

SEQ ID NO: 366441 - DNA, 391 bp, Homo sapiens
tcagagaagattatttccggctttatcttcaaaaactggaaaggaagggtcaaagaaaagacagtagcttatgttcatggcaagcacctctcatcacagtccagttccaaggaaaaattccagcattttctacattggctgctgccttgtctgaaatcagcactttccatggaggaaggaaacctgctttgttgcatcttctattctcgggtttaatgttggtaaatgagtaactctagcatttgtacaaggctccctaagactcctgcagctgtcgacaaagcccagggacataattgaatctggagattcctcaggccttgttttgaaaaagacttgaaatacacataggaagaaaggtacaaaaataaatgttcacttgtctctgcaa

SEQ ID NO: 366442 - DNA, 533 bp, Homo sapiens
aattcttgagggccccttgtgccaaaatttggcccttgggtggggacctacaggataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaa

SEQ ID NO: 366443 - DNA, 281 bp, Homo sapiens
cctttgcagctgtcggtggcgctacgtcagggccgcgatgaggcactcgtgagcgtctgctgctcgtagcctgctaggtgcctcgcgtgggtccacaccaggcccagtaatgccaaccacctatcccctcaagccctcaagtggcgggaatacaggaggaagaacccactagggccacctggtttgtcagggaaagccaaacccccgacaatgacaacatattgtcccttgcaaaacttaaaaagaacttactcaagtcaccaaacaccacctgtccccag

SEQ ID NO: 366444 - DNA, 5286 bp, Homo sapiens
aggaaatcggcccagttcacctgtgtgatcccgtggaacagtgtctcagctggaactgtcgcggtagagcttggtcggagtgcaaaagggacagacgcatcaggggtccagctcaaggctcctgacagaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctgctccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaa

SEQ ID NO: 366445 - DNA, 2195 bp, Homo sapiens
gcaaggcaggaggcaaggcaaggtaaggcacagaaaaacgcaaggcacaaggaaagggaggtcacaaggcaaggcacaaggcaaggcaaggcataagcaaggcatggcataagcaagacaaggcaaggcacaaggcaaggcaagtacaaggcaaagcaaggcaaggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaa

SEQ ID NO: 366446 - DNA, 990 bp, Homo sapiens
  misc_feature (24)..(24): n is a, c, g, or t
ccaggctggtacgcccccgagtantgggatatcgtcgaccacgccgtctgggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaa

SEQ ID NO: 366447 - DNA, 757 bp, Homo sapiens
aggaaatcggcccagttcacctgtgtgatcccgtggaacagtgtctcagctggaactgtcgcggtagagcttggtcggagtgcaaaagggacagacgcatcaggggtccagctcaaggctcctgacagaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctgctccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctctgcgtttgcaaacgcagagaggacaaggggcccaaggagtgccatgtagcactcctgctttgtgaggacagctcatgtggtgggtcttgccggctctat

SEQ ID NO: 366448 - DNA, 345 bp, Homo sapiens
gtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacggtaaggagcctaagggttagcaaatatgtggctattcaccagcaggatatgcatggccacctccctgacaggtccctgccagaccaccccatccataccactagaggttccacatcctagatctgttatccttctaggccagggcaggacccacagctacagtggaatagg

SEQ ID NO: 366449 - DNA, 5384 bp, Homo sapiens
gagcaccttaggccgggcggaccgaaccaacgcgccgcccggaggggcggcctgagggcaacccagatcggaccatcgcgccacgccgacaggggccggcctttccaacccgcccggagggaggggccgccggcgcctctagcctgcaacgcgacccctggagggcgagacacgccgccgccgccgccgccgccggcgcggaaggacgaggctgaggcgagaaacgaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctgctccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaa

SEQ ID NO: 366450 - DNA, 6617 bp, Homo sapiens
aggaaatcggcccagttcacctgtgtgatcccgtggaacagtgtctcagctggaactgtcgcggtagagcttggtcggagtgcaaaagggacagacgcatcaggggtccagctcaaggctcctgacagaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctgctccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacgggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatgccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggccaagcagtgaagccgttaccactgacctgccctgacttccaggaccccttttccttgacggagaagcctccagctgagttttgtctgtccccagatggcagctcagaggccatttccattgacctgcttcagaaaaaagggctggtaaaagctgttaacatcgctgtggacctcattgtggctcattttggcacaagccgggatcccggggtgaaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggcccatccaccaaggtcctgcatggcctctacaacaaagtcagccaattcccagagctcaccagtcataccatgcgcttcaacgccttcatcctcggcctgctcaacatccggtccctggagttctggtttaatcacctctataaccacgaagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaaaaaaaaaaaaaaaaaaaaaaaaaaaaaaaaaaaaaaaaaaaaaaaaaaaaaaaaaaaaaaaaaaaaaaaagggggggcggcgcgcgacacaaagatacaccccgcggggggccacccaccctccggcgcgcgcacacccatctttttggagaaaaaggggggcgccaataggcggtggggcgatatcatatacgaaggaggggcggggggcgcagcaaaaaaagagatgcgggagcgggagacaaaacgcggcgcgacggcggcacacatcgtcggagacaggagacccctccccccgcgggagcggggggacacacagaagggggggagaaaaacacacaaaaaagacagagaataaaacccgccaccagaggcgaccaacacaacaccacccaacaagaaggagaacacgggggcgacacacaacaccagccgcaactccgtgagccaggcccgaaacaaagactgtcacacaaactagaagacacacagcaccacaaaaaaaaaaaaaacaacccggggggcgggttatagttaaaaacgcggccctgtccacatacctgacaacgcgagacgagccgcacacaaccacacccgcacgagagaccacacacgtcgcaggcgccagccgcacgccgcatgctcctcctgaccacacagcaccacctcgccgccacaccacccccgccacccgcgacccccgcaacgcaacctcgccgcgcccgacgacagcaccgagaagagaccgcaaaacagaccaataactaaagaggcgaagctaagcagagcagacggcccacagcggaaccagcacaggagagacaagcagcaagcagaaacaggaagcagacacaggcgacacgagcgagaggcgcggcgcgaggagagaaggcagagagcagcagggagagacagagcgagcagaaagagagagcacaggacggacgacacgaggaggacaacaagcgaccagcggcgcgcaagcaccagcacgcgcagaaaagcagacgcgagaacaggcaggaggcgaaggcgaagacacacgagaagcgaaagaagtcgacagaagacgagaaagacgaacgacgagagcggacgcgcgacggcgggcgacagagaggaacgcaaacaggggagccgaagaagccaacgggcgacagcacggagagcagagactaagagaaaacgaggacaggggcacagcagagacacgaggacggagaaagaggaggaaggaacaagagcgcagcgacgcgcaacgtccggcggagggacgggaggagaggagagagaacaggactgggccaagacgaaagaagaaggcggacgac

SEQ ID NO: 366451 - DNA, 2040 bp, Homo sapiens
gcagaggttgcagtgagccgagatcatgccactgcactccagcttgggcaacagagtgagactcagtctcaaaaaacaaaacaaaaaaccttggagccagcaggatactctagcaatctgggagttagggtggccaggaatccctgcatctcactcctctaaactcagggccaccgcctggggttggagagtttaggcactgcacagctgtgggcagcagcgtttatacttagtacatgcaagctgactagtgcacagcctgcaccgctgtctgcagcagctctgcccagactgtctttcaaagtcccacttgggccaggctctggttctctgtgtggatcagtccctctctcttttcccctagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggctcccctcggactggctgagcctggacaagtccatgttccaactagtggcgcagacagtgggttcccgccgggagccagagcccaaggagagcctgcaggagccacactccccagccctgccctccagtcctccgtgtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctccaaa

SEQ ID NO: 366452 - DNA, 1290 bp, Homo sapiens
gaaatcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacatcccgaagtgctgggattacaggcatgagccaccacacctgtccctctccccctcgtattactcagacttaaactaccccaaaaaggctaaagtcctgctaagagtctccgtagaactgatgattcaagaggctcttatgatcacagctggtgattccctgtgttgaattagtgaaaacaggccaggcacagtaatcccagcactttgagaggactgcttaatgtcaggagctcaagcccagcttgggcaacacagatgcctgtctctacataaaacaataaaaatttttaaaaaaaatttttttttaatgcccagaacaatagggcatgattcaaaattatcctccgagctgcctctctggttctttctgggaaaaacacttaggcaagttgagaaaggaaggaaagttggaataatggcaaaactgttagaagcattcctctttcctccattgcctgtcctcccaacattatacccaaactagttacaaagccattctgtaaagagatcgggtacctacaatttcttcagatttacacaatatccactagaatttaatttctacaagggcagggatctttgttgagtggcacatggtagacactcaataaatacttattgaatagatgggttaagtgaaagtggcagggatcaactagagtgtcctgtgcttagggtcttttaataaagatggaaagaatgatgttaaa

SEQ ID NO: 366453 - DNA, 644 bp, Homo sapiens
gaaatcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttaaaaaacttgata

SEQ ID NO: 366454 - DNA, 474 bp, Homo sapiens
aattttatagagtcagggtttccctgtctctacataaaacaataaaaatttttaaaaaaaatttttttttaatgcccagaacaatagggcatgattcaaaattatcctccgagctgcctctctggttctttctgggaaaaacacttaggcaagttgagaaaggaaggaaagttggaataatggcaaaactgttagaagcattcctctttcctccattgcctgtcctcccaacattatacccaaactagttacaaagccattctgtaaagagatcgggtacctacaatttcttcagatttacacaatatccactagaatttaatttctacaagggcagggatctttgttgagtggcacatggtagacactcaataaatacttattgaatagatgggttaagtgaaagtggcagggatcaactagagtgtcctgtgcttagggtcttttaataaagatggaaagaatgatgttaaa

SEQ ID NO: 366455 - DNA, 522 bp, Homo sapiens
gaaatcctcggcctcggtggcggtggtggacacgtcgagccgggtagaagtggaggggccgttcgaagagtcgtgagggggtgacgggttaagattcggagagagaggtgctagtggctggacttgacctggaaaggatcttgctttgttgcccaggctggagtgcaggagcacaatctcagctcactgcaacctctgtctcccaggctcaagcaatcttcccatctcagcctttcgagtagccgggactacaggcatgcaccaccacgcccagctaattttttgtatttttgatagagtcggggctttgccatgttgcccaggctggtctcaaactcctgagcttaagcagtctgcccaccttggcctcttagagtgctgggattacaggcatgagccaccatgtccagcctcatttgcattcttgtactgcattttcattaaatcattcaagttccttttatctgtgtaacatatttaattgcattttcctactgaataaaaaaaagggaacagttcaaa

SEQ ID NO: 366456 - DNA, 1667 bp, Homo sapiens
gaaatcctcggcctcggtggcggtggtggacacgtcgagccgggtagaagtggaggggccgttcgaagagtcgtgagggggtgacgggttaagattcggagagagaggtgctagtggctggacttgacctggaaagcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttaaaaaacttgata

SEQ ID NO: 366457 - DNA, 1184 bp, Homo sapiens
  misc_feature (33)..(33): n is a, c, g, or t
  misc_feature (40)..(40): n is a, c, g, or t
  misc_feature (127)..(127): n is a, c, g, or t
  misc_feature (136)..(136): n is a, c, g, or t
  misc_feature (193)..(193): n is a, c, g, or t
ttcatggtcatattaaggctagtttctataatngtcaggnaggactgttctgtcttttctatttatatgaagctactatagataaaatcagagagaagattacaataaaatgtagaccacatacganacctaaaanttgaaaagtaatttactcagtgagggttttaagtccatcacatttctattctaaaanaaaagcttgcagagaattaaaacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttaaaaaacttgata

SEQ ID NO: 366458 - DNA, 1259 bp, Homo sapiens
tcatgtctggctaatttttgtatttttagtagagatgagtttttgccatgttggccaggctagtcttgaactcctgagctcaggtgatccgcccgtctcggcctcccaaagtgctgggattgggaaaggtgtgagccactgtgcccggccataatacctgtttgaattaggcacctagcacaaaataggtattcgagccttagtattttttttattatctacaattgttgttactccagctttcagaatgaaaagtaacactcttcttgataaggttaataggttagtatttttctttttttgttgttgtttttgtttttgagacggagttttgcccttgttgcccagactcgagtgcaatggtgcaatctcagctcactgcaacctctgcctcctgggttcaagcacctccacctcagcctcccgagtagctaggattgcaggcatgcaccaccacgcccggctaattttgtatttttagtagagacagggtttctccatgttggtcaggctggtctcaaactctggacctcaggttatctgcccactcccgaagtgctgggattacaggcatgagccaccacacctgtccctctccccctcgtattactcagacttaaactaccccaaaaaggctaaagtcctgctaagagtctccgtagaactgatgattcaagaggctcttatgatcacagctggtgattccctgtgttgaattagtgaaaacaggccaggcacagtaatcccagcactttgagaggactgcttaatgtcaggagctcaagcccagcttgggcaacacagatgcctgtctctacataaaacaataaaaatttttaaaaaaaatttttttttaatgcccagaacaatagggcatgattcaaaattatcctccgagctgcctctctggttctttctgggaaaaacacttaggcaagttgagaaaggaaggaaagttggaataatggcaaaactgttagaagcattcctctttcctccattgcctgtcctcccaacattatacccaaactagttacaaagccattctgtaaagagatcgggtacctacaatttcttcagatttacacaatatccactagaatttaatttctacaagggcagggatctttgttgagtggcacatggtagacactcaataaatacttattgaatagatgggttaagtgaaagtggcagggatcaactagagtgtcctgtgcttagggtcttttaataaagatggaaagaatgatgttaaa

SEQ ID NO: 366459 - DNA, 588 bp, Homo sapiens
aattttatagagtcagggtttccctgtgttgcccaggctggtctaactcctggactcaagcaatcctcctgcctcagccactttgagaggactgcttaatgtcaggagctcaagcccagcttgggcaacacagatgcctgtctctacataaaacaataaaaatttttaaaaaaaatttttttttaatgcccagaacaatagggcatgattcaaaattatcctccgagctgcctctctggttctttctgggaaaaacacttaggcaagttgagaaaggaaggaaagttggaataatggcaaaactgttagaagcattcctctttcctccattgcctgtcctcccaacattatacccaaactagttacaaagccattctgtaaagagatcgggtacctacaatttcttcagatttacacaatatccactagaatttaatttctacaagggcagggatctttgttgagtggcacatggtagacactcaataaatacttattgaatagatgggttaagtgaaagtggcagggatcaactagagtgtcctgtgcttagggtcttttaataaagatggaaagaatgatgttaaa

SEQ ID NO: 366460 - DNA, 309 bp, Homo sapiens
gtggaggggccgttcgaagagtcgtgagggggtgacgggttaagattcggagagagaggtgctagtggctggacttgacctggaaaggtaaggcttctctcggcccctctttcgcacccctgtgcatgggtaccgtccttttcccagcgggacaaggaccttcctcgccgctttcctcagctccgcggaaggagaaagagctcgggactggagggttaaagactggggcttcggcccggcccctgcagtggcatagccagagtgaccttgggccggggtgctcggtgcctcagtttccccgtgtatgca

SEQ ID NO: 366461 - DNA, 1831 bp, Homo sapiens
gaaatcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttaaaaaacttgata

SEQ ID NO: 366462 - DNA, 1688 bp, Homo sapiens
  misc_feature (1688)..(1688): n is a, c, g, or t
gaaatcctcggcctcggtggcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccaacaaagacgagccgtcggtccggggacatggctcccatgcgttccaactgggggaggggtgacacggccacggaggtcgggggaccgccacaggggcaaaaacgaaatcacccaaactgcggagggccgctgcgctcgcgccctctccatgccatcccn

SEQ ID NO: 366463 - DNA, 1263 bp, Homo sapiens
ggcgggtgacctagaggatccccccatcatcacccatgtgggcatcactgcatgtcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttaaaaaacttgata

SEQ ID NO: 366464 - DNA, 438 bp, Homo sapiens
ataaaaatatatccatattgcatatttgagaatttctttacatttttatttacttgattgtttatgttattggagttgaaaattattttcacttagaattttgctcagttttcttctattcttgagagtttctgttgaagtgctttggcattctgattcccagtcgtttacacatggcctattttttctgtggaaatatttaagattttctctttatttctgatctaagtttttatagtgatgtgtgttgctttgactttgattattatttttatttagttagtttttgagatagggtctcgccctgtcacctagacaggagtgcggtgacacaattatagctcagtgcaacctcaaattcctgggctcaagctatcctcccacctcagtctcctgagtagctgggaccacagacacgcaccaccaggcctggctaat

SEQ ID NO: 366465 - DNA, 595 bp, Homo sapiens
ctggtaatcattgaagaatcattgtattgactattaaacatctagggatcacctgtttaaatcaagttaacaaaacacttacttaacaaatatatattgattgcctattatgaagtagatgctatagtaggtgctggcagtataaacatgaaaagagacattgtgtgtgcatattaatatacagcaaattaaacttcagccagagaagtactttactagaaggttgatagaagtgtggtggtagcttgcaggaggaagcagttagcctccttggaaatgagtaatcttcacagaaagtatgacatttgacctgcttcttggagaagatgcatattaaacctattaaatccatgtcagcctttaacacctttgctcagattagtttctcgagctgttttcccacctggtgagcagataagagcaggacaggaaagttctgatgaaaggaagaagtgccagagagagaaggccttgcaagcaaagaagcctgacaggcaggagcccctgagtatcctaaggagaagtaccagcgatttagggaagaaaattgctgccagaagtgcaggaaataaaaattctgacctagatcatttta

SEQ ID NO: 366466 - DNA, 689 bp, Homo sapiens
ctggtaatcattgaagaatcattgtattgactattaaacatctagggatcacctgtttaaatcaagttaacaaaacacttacttaacaaatatatattgattgcctattatgaagtagatgctatagtaggtgctggcagtataaacatgaaaagagacattgtgtgtgcatattaatatacagcaaattaaacttcagccagagaagtactttactagaaggttgatagaagtgtggtggtagcttgcaggaggaagcagttagcctccttggaaatgagtaatcttcacagaaagtatgacatttgacctgcttcttggagaagatgcatattaaacctattaaatccatgtcagcctttaacacctttgctcagattagtttctcgagctgttttcccacctggtgagcagataagagcaggacaggaaagttctgatgaaaggaagaagtgccagagagagaaggccttgcaagcaaagaagcctgacaggcaggagcccctgagtatcctaaggagaagtaccagcgatttagggaagaaaattgctgccagaagtgcaggaaatacttgggggtccttttataatcacatttcattaaccaggcaagattaatcagtgaccagataggacagtcactgactcttaagactttacaatttgaaacagtgtgtacaaatgtatag

SEQ ID NO: 366467 - DNA, 1965 bp, Homo sapiens
catatatgtgcactgataaaagaaaaatgaacaagatgtagaggagtaagttatcatttgctttaaaagattgtgtgtgcttgcatatgcatagaacatttatgggaagatactgaaaaatgtttaacagtatgtctaagaaatagaacagaggtcttcagggaatgggtggtaaggaaaagagactgtactcttcattatatatttgttcttagtgcatgtatatttttaaccatgtaaatagtgttctttatttaaaaacagtattttaaagtttctataatgtaaatttttatttggtaaatctaataaattacttaattccatatcatgccatctctaaaatcttttggaaattgcctcccctctgtcgtgctcattaataaaacaatattaagagtagtaaccctacttacttcagaaagtagttgtttttattaatggcatatgaaagcaatttgagaaccataaactaatatggaaatataaggcattctaaggacagagatgaaaagggaaggatataggggaggataaaggaaagaggaaaagcagaaagaaaaaggaaaaaaatactcagttgggttctgggatagaagtctgataagaactttttgacatcctgtcatttatttgaatgacttgttcctcaaacccaacgcgcacatttcatgttttttttagtttttttttctgttttttttcctgtttgatagctgtcagttatagtgattggtatttaatacaaaaaaaaccaaagatatgaaaattgttctatattttaatctgcaaattgctccattaggcagatttaattatttgtggatttacttatggtgcttccagatatcttgtacctcttaatgtgaccatcagaaaacttgactgagaaacatttgtactatacaaaatacaaaatgctttcagtatattattgcaagtgcttcttaaaaacatatagtattgttaaatgtgtactttttaatgttgtcttgtttaaattggaaaattaaccaaatgttatccatttaaacatgctttataacatattaaatgtgagtgcttaataagtacttttaatgatactggtacgggtgttggaacccagtcctagtcaagagtctaaatcttcatctctgtttttcagacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatataggtatgatttttttttctttggctttcccaagacatgtttatttaaaaatgtgtttgaggaacaaaaatgtgtttgaggaataaaaatttctattacaatttattttattgatcagggattctaagtatatataattactaggccagtaatatatataattgatatgtcccattcttgtggatagtaataatagctaacatctatacagttataacaaaaacaacaatagcaaagatagagttttactgtgtgccagacactgttctaagattacacgtatctacttactgaatcctcagactaactctatgaagcaaattctgttatccttatttataagtaaaggaagaaaggcacagaaaggttgagaaacttgcccaagatcacatagctagtcagcggtagagcaagatttggggaagagtcccagaagataccctggctgttaaactagccctgctgggcaaatgaaaaggcacctacatttctagcacaagtacaagtttgtggtgcccagaccttttctctctactttgtcactgtatgctgattctgggaggtaaatggaaccaagtcaatttatagttttatcccatctcagccatcatcatctgtattttctctagcccttaatcatttggat

SEQ ID NO: 366468 - DNA, 1843 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366469 - DNA, 998 bp, Homo sapiens
ttttctggatcattgttactcttccgttttttgtatagttgtaaccagagtattctttaaatacatttttatggcatccctattatgtacaaaacacccacaaagccttatgtaggtaagtgatacataggcccctacctcaaggagcttactgtctgaacaggggagaggtgtggtgaaggatggacaaattatatgtatttgtaagagtatataatttatggtaaaacaatttcaagaaaggattaaaccatgtgttataatgtttcaaagaagggagagattataaaccactggggtaaaaggataggcttcttggaggaagtgacatttgagatatatcttggatgaccgatcagattcccatagaagaggtctgagaaaagggcattccatgtagaaggaatgacaagagcaaagacatagagagttaattagaaaatgcttgtcatttatttcataattcgggggaaattattttgttttataacacttttaaaaaatatttagctttgcagttcctgaccccttaatgcctgacccttccaagcaaccaaagaaccagcttaatcctattggttcattacaggtaagttgtacagttctttgcctactgatgaaatatataataagtttgtaatgtcagaggggctaacacaaggaattaatattttaaagacaagatagtgatatattttgttttccaacttacgatcattagattaacagagctaacttgaaattattttcctatttatgttctgggttttctttcatatacagtatttgcctttggcttatagaattctcatttaagatcaacaggccctcagtgcacatgggtaaagtgttttatactttaagaatagttcttgctactcttgtgacaaatctctttctacttctgttgagacagaagactttatagagagcctaaatcaaatcagtgaacctaactgaagaaaaggagtctatttgcttattctaccaaaaaaaaa

SEQ ID NO: 366470 - DNA, 643 bp, Homo sapiens
taatcccagctgcttgggaggctgagacacgagaattccttggacccagtgggcagtggttgcagtgagctgggatcgcgccattgcactccagcctgggcgacagagcaagactctgtctccaaacaaacaaaaaaagacatgccaaatgacatggcaggtattgggttctcccccactggtgatggccatgctgtttctgtatagcctgaaggtgaacccaaccattaagtacatttgtagaaatgaggggtatggagtgtcctttctgcatcttggcactttgtcagcaaaaaaagctaacaaactttactatatttgtgcttcttgacagataaaatgggaattactaagctgtaatcaggcctaaagtggcctgactttaatacagagactttctcacttctccatcacaattatttgggtagcttcggcatgcagcattgtaagtgaatactcatatctcatcagcctatgtaaagcttgaaattctcacagttggaaaaaaaaaaccttgaggaagtggcaataactaaacctcatttgtcatggaaaaatgactccagttgcctaggtggtactaaccttgaaatgccgcttattcagttttaagtactgacctgctaagtaactagtaattcca

SEQ ID NO: 366471 - DNA, 1714 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtca

SEQ ID NO: 366472 - DNA, 1480 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtc

SEQ ID NO: 366473 - DNA, 1798 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtcaaaaaaaaaaaaaaaaaaaaaaaaaaaaaaaaaaaaaaaaaaaaaaaaaaaaaaaaaaaaaaaaacaaaaagacaacagcacaaaacaacgactcagagcaaacaaaaacaaggacaaccaacaagaagagacgcgacagctaaacgaagacaccacacaccgccgaggccgagaaacgcctcaacagaaagacacaccaaaacaaaggcgcacccgccgaagcgacacaacagcacgcagcagacaaaatgagatgcacaaccgacggagagagcactcaaccagagcagcaaacaagaaccagcataacgcgcaaa

SEQ ID NO: 366474 - DNA, 2247 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366475 - DNA, 1954 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgataaaatgggaattactaagctgtaatcaggcctaaagtggcctgactttaatacagagactttctcacttctccatcacaattatttgggtagcttcggcatgcagcattctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366476 - DNA, 1817 bp, Homo sapiens
ttttctggatcattgttactcttccgttttttgtatagttgtaaccagagtattctttaaatacatttttatggcatccctattatgtacaaaacacccacaaagccttatgtaggtaagtgatacataggcccctacctcaaggagcttactgtctgaacaggggagaggtgtggtgaaggatggacaaattatatgtatttgtaagagtatataatttatggtaaaacaatttcaagaaaggattaaaccatgtgttataatgtttcaaagaagggagagattataaaccactggggtaaaaggataggcttcttggaggaagtgacatttgagatatatcttggatgaccgatcagattcccatagaagaggtctgagaaaagggcattccatgtagaaggaatgacaagagcaaagacatagagagttaattagaaaatgcttgtcatttatttcataattcgggggaaattattttgttttataacacttttaaaaaatatttagctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366477 - DNA, 1752 bp, Homo sapiens
taatcccagctgcttgggaggctgagacacgagaattccttggacccagtgggcagtggttgcagtgagctgggatcgcgccattgcactccagcctgggcgacagagcaagactctgtctccaaacaaacaaaaaaagacatgccaaatgacatggcaggtattgggttctcccccactggtgatggccatgctgtttctgtatagcctgaaggtgaacccaaccattaagtacatttgtagaaatgaggggtatggagtgtcctttctgcatcttggcactttgtcagcaaaaaaagctaacaaactttactatatttgtgcttcttgacagataaaatgggaattactaagctgtaatcaggcctaaagtggcctgactttaatacagagactttctcacttctccatcacaattatttgggtagcttcggcatgcagcattctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366478 - DNA, 2318 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366479 - DNA, 2162 bp, Homo sapiens
catatatgtgcactgataaaagaaaaatgaacaagatgtagaggagtaagttatcatttgctttaaaagattgtgtgtgcttgcatatgcatagaacatttatgggaagatactgaaaaatgtttaacagtatgtctaagaaatagaacagaggtcttcagggaatgggtggtaaggaaaagagactgtactcttcattatatatttgttcttagtgcatgtatatttttaaccatgtaaatagtgttctttatttaaaaacagtattttaaagtttctataatgtaaatttttatttggtaaatctaataaattacttaattccatatcatgccatctctaaaatcttttggaaattgcctcccctctgtcgtgctcattaataaaacaatattaagagtagtaaccctacttacttcagaaagtagttgtttttattaatggcatatgaaagcaatttgagaaccataaactaatatggaaatataaggcattctaaggacagagatgaaaagggaaggatataggggaggataaaggaaagaggaaaagcagaaagaaaaaggaaaaaaatactcagttgggttctgggatagaagtctgataagaactttttgacatcctgtcatttatttgaatgacttgttcctcaaacccaacgcgcacatttcatgttttttttagtttttttttctgttttttttcctgtttgatagctgtcagttatagtgattggtatttaatacaaaaaaaaccaaagatatgaaaattgttctatattttaatctgcaaattgctccattaggcagatttaattatttgtggatttacttatggtgcttccagatatcttgtacctcttaatgtgaccatcagaaaacttgactgagaaacatttgtactatacaaaatacaaaatgctttcagtatattattgcaagtgcttcttaaaaacatatagtattgttaaatgtgtactttttaatgttgtcttgtttaaattggaaaattaaccaaatgttatccatttaaacatgctttataacatattaaatgtgagtgcttaataagtacttttaatgatactggtacgggtgttggaacccagtcctagtcaagagtctaaatcttcatctctgtttttcagacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366480 - DNA, 1267 bp, Homo sapiens
gcataacaaacaaagttatcaggtcagtaagaacatagtctagtatataataaaaaccgtgaggttctctgattaaacacagtacttcatacgtttgatcatcctctgtggacactaatttcttttctaaatctaccatttctttttctttgttcaggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366481 - DNA, 2302 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactgacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366482 - DNA, 801 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggtacttatttcttacaattaaaggcatttgaaatattttcagatgatgaatgactatcgaaatttctg

SEQ ID NO: 366483 - DNA, 1355 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggtacttatttcttacaattaaaggcatttgaaatattttcagatgatgaatgactatcgaaatttctg

SEQ ID NO: 366484 - DNA, 453 bp, Homo sapiens
cttcagaggtgtgacacggtctactttattaccatgttatataataaacatatataatgtagaaataaggatttttatgcaggtatgcatagaattatatagaactttaaaaagttattttttaaaattttttcacatggtgaatattttattacagtatataaccatgtagtatataacatgtacatatttttatgtacagtatataacgtacatatttttattacctagtatgtgtatgtaaaatctatagtgactttgttttgtgtattgaaaacatctttgtaagctgcacatttttgtgggagataaagacttctttttttaaatcttaattcaggtgaaggtacaagtaagaagctggcgaaacatagagctgcagaggctgccataaacattttgaaagccaatgcaagtatttggtgagctaaatttctttgtattcagcagctc

SEQ ID NO: 366485 - DNA, 1877 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacatacatgtaatgggttacttccttactttctctaag

SEQ ID NO: 366486 - DNA, 2397 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366487 - DNA, 1673 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366488 - DNA, 2446 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttggtgagctaaatttctttgtattcagcagctcaaaaatatcatggctgagctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacat

SEQ ID NO: 366489 - DNA, 1469 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagattatatctcttctagtgtataagcttttaaggtcactggtcgtacgttttaacttggcccaggagggtggccattgggcgcgcttaaacggggtgggggggaaaaggcggaggctgggggactgcagataggaaggcaatgggccctttttgaaggggtgtaaagctacaggggg

SEQ ID NO: 366490 - DNA, 1646 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatataggtatgatttttttttctttggctttcccaagacatgtttatttaaaaatgtgtttgaggaacaaaaatgtgtttgaggaataaaaatttctattacaatttattttattgatcagggattctaagtatatataattactaggccagtaatatatataattgatatgtcccattcttgtggatagtaataatagctaacatctatacagttataacaaaaacaacaatagcaaagatagagttttactgtgtgccagacactgttctaagattacacgtatctacttactgaatcctcagactaactctatgaagcaaattctgttatccttatttataagtaaaggaagaaaggcacagaaaggttgagaaacttgcccaagatcacatagctagtcagcggtagagcaagatttggggaagagtcccagaagataccctggctgttaaactagccctgctgggcaaatgaaaaggcacctacatttctagcacaagtacaagtttgtggtgcccagaccttttctctctactttgtcactgtatgctgattctgggaggtaaatggaaccaagtcaatttatagttttatcccatctcagccatcatcatctgtattttctctagcccttaatcatttggat

SEQ ID NO: 366491 - DNA, 1024 bp, Homo sapiens
gaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggtaagttgtacagttctttgcctactgatgaaatatataataagtttgtaatgtcagaggggctaacacaaggaattaatattttaaagacaagatagtgatatattttgttttccaacttacgatcattagattaacagagctaacttgaaattattttcctatttatgttctgggttttctttcatatacagtatttgcctttggcttatagaattctcatttaagatcaacaggccctcagtgcacatgggtaaagtgttttatactttaagaatagttcttgctactcttgtgacaaatctctttctacttctgttgagacagaagactttatagagagcctaaatcaaatcagtgaacctaactgaagaaaaggagtctatttgcttattctaccaaaaaaaaa

SEQ ID NO: 366492 - DNA, 888 bp, Homo sapiens
ggctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtaggtgcctgcacgcgtcggggtcgcggcctttggccggaccggggcaagaagactgaggagccgccccgcgacttcgatccggcgctgctggagttcctggtgtgcccgctctccaagaagccgctcaggtaactcgctggccttggcccttcctttgcagcctcccggtgggcggaaagggagcggtggaccgcggcctcttgcagccactggggccttgtaggtcggtcaggtactctccgctgccacattctggactctgtcctcgccgggcgcacagcgggcaggacgggggagaccggaggccaggggagctgcgtcccacatctcccagaacgcaacgccagcctgcgggaatggctcgaagcgttttagggttcgcgaccggctgcgcattgcaatcacccggggaccgttttaaaaatgccgattccccgacagcccccaagacgggcagacttggaatgctcgcgggatgggacctgaacatttgtatttcttttcctttatttatatccttttaagagacagggtgccccctacgttgcccagactggccttaagaactcccgcctcagcctcctcaggagtcgagagacaggcgccgcccccaggcccagctaatctgtgttcttaaaagggtccctaaatgatttctaatgtaccaccaggtttatgaaccactgcgattcaggacaagtccgaagccttccggtttttaagccaaga

SEQ ID NO: 366493 - DNA, 1331 bp, Homo sapiens
ggctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtaggtgcctgcacgcgtcggggtcgcggcctttggccggaccggggcaagaagactgaggagccgccccgcgacttcgatccggcgctgctggagttcctggtgtgcccgctctccaagaagccgtcagatatgaagcatcaacaaacgaattgattaatgaagagttgggaatagcttatccaatcattgatgggatccctaatatgataccacaggcagctaggatgacacgtcaaagtaagaagcaagaagaagtggagcagcgctagttcataatttaaaaaaattaaaaaaacgcaacagccaacttttcttaataccatataccttttaaaacacagtggcaggtaataagtggaagagaagaatgtttctgtctcttcctacgttgactgttcttattccactggtttctttagcaggactgttctactcagcctctgtggaagaaaacttcccacagggctgcactagcacagccagcctttgcttttacagcctgctcttgcctattaccataccagtgtatgtattcttccacctttggacttggatgggtattaaactcttcaggcataattgatgcaactagagtcaatatgctgtatatattaatgatagctcttgggcatcgatctctgaaagctcaaatggatggaatttagtttgcgggaaagaggctttgctttgcgcatatcaggcttaggactgtgggaggcttaagttgcagatgcttcttttattgtactcttgttctgcccttgttttttgaaggctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaataaaccagtttgcagta

SEQ ID NO: 366494 - DNA, 794 bp, Homo sapiens
ggctggcctggacgaacgggaagccgggagctcggccacgggtggcgaggctgcggtgaggcctggtctccggctgccagaccatgctgagtggagcacgctgcaggctcgcctcagcgctgcggggaacgcgcgcgccgccgtccgcggtcgcccgtaggtgcctgcacgcgtcggggtcgcggcctttggccggaccggggcaagaagactgaggagccgccccgcgacttcgatccggcgctgctggagttcctggtgtgcccgctctccaagaagccgtcagatatgaagcatcaacaaacgaattgattaatgaagagttgggaatagcttatccaatcattgatgggatccctaatatgataccacaggcagctaggatgacacgtcaaagctctgacttataactgctgtatcagaagaaacattttgacagtgtcttggttggagatgaacatccctaattgacatgtgatgactatttcttattccattcatctaagagtcattgaaattttgttttgcttgtttgtttagcttcaaggtctttggtaaagtcacatgttaaggatgactgaaataattccaaaggagtgatgttggaatagtccctctaagggagagaaatgcatttgaacgaatgtgatataaaaccacataatcaaatagaaacttcatgtacttacaaaaactgagtttgtaaaattaccttcatttctttgacattaaatgcttatattagcaataaacatgttgacactttcctataaaaaataaaccagtttgcagta

SEQ ID NO: 366495 - DNA, 445 bp, Homo sapiens
actttacagagattatcttgtctagtcccgtcagaaccctataaggtagataggtgtcattagtaaaaatggcttgtattttacttaggagtgtgttttttgtacttgtatgaaagtacagatatatttacatctgagactttattgaaaatgaaatattgaaatcacacatgtatgacttggtttgggaataactggttgtatttggttccccataccattttctggtcatctatctgtatgctgtccatctgtttgtcacctggtatcacaggaaataccagacttttcttgttttttgtaattaggtaaaggcaaaataatagcaaaagctgagagctaaagcagtgaattgaacagcacccaatatagcctgttaatttgcacactggtttataatggagctattgcagcagtgagaggcttctgaggataatcgggttgt

SEQ ID NO: 366496 - DNA, 478 bp, Homo sapiens
ggtggtgcaatcatagctcactgaagccttgaactcctgtgctcaagaaatcctcccacctcagcttcccaaatgtctggggctacaggcatgcaccatcacacttggctaattttttttttatttttgtagagacagggtctcaccatgttgtcaagactggtcttgaactcctggtctcaagcaatcctcctgcctcagccttccaaagtaccgggattacaggcatgacccactacactcagccccactggtggtcttttcacatggattatcatctaaatactccatttcttccagcctcaagaatagtctaacagagagccgacagagtgagtctagtgggctttccacacatgagtgaccactcttcagttgatatggtcaagcacaccactttacctcctgacctcaggtgcaattagcttccaaatattccacatgctccagtggacctttctaattgtaagcatccccc

SEQ ID NO: 366497 - DNA, 6258 bp, Homo sapiens
  misc_feature (4408)..(4408): n is a, c, g, or t
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccactgcactccagcctgggcgacagagcaagactcagtctcaaaaaaaaaaaaaattagctgggcagggcatggtgatggtgcctgtaatcctagctacttgggaggctgaggcatgagaattgcctgaacccaggaggtggaggttgcagtgagccgagatcgtgccactgtactccagcctgggtgacagcgcgagactccgtctcaaaaaaagctgggtgtggggaacacctgtggtcccagctattctggagactgaggcaggaggattgcttgagctcaggagttctggctgcagtgagctatgatcatgccactgtattacagaatgggtgacagaatgagagcgacactgtctcaaaaaaaaaaaaaaaaaaaggccgggagcggtcgtttgtgcctgtaatcccaacactttgggaggccagggtgggcggatcacttgaggccaggagttcaagaccagcctggccaacatggtgaatccccatctctactaaaaaaattaactggacatggtggtggacacttgtaatcccagctactcaggaggctgacacatgagaattgcttgaacccgggaggcggaggttacagtgagccgagatagcaccactgcactccaacctgggcacagagtaaggctctgtctttaaaaaaaaaaaaaaaaaaaaagttttgtcaaaacttagcagagcaaggctaagaaagctcaggaacctggggcctcggcgatgcctgtagtggcaacttatgtataggggctgcagggagaggttaggctgtggcattgagccctgatagcccctatcatcaggaagtggtagatttcagttaatcctgagttctgga

SEQ ID NO: 366498 - DNA, 3830 bp, Homo sapiens
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctca

SEQ ID NO: 366499 - DNA, 4992 bp, Homo sapiens
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatactgcactctagcctgggcaataagagcaagactgtctcaaaataaataaataaataaataaatagtgtttctcacttgttggcccttggccctcagggatcccctgactgctccatccaattctgggccccctcctcacattacccccacccccagcatgactggtccgtcggagtcttacgctcttcaaatcggtctagctcaggggctggagccttctgtcgtgcaggaggggcctttcttttccgttcctccatgtccttccctgtggcaaagatattttggagtctttgtttctccttctccaaatcccctgtagggccaaaaagaaatggcctagttaggctgtaaagggtgcccttattcatggtctgtgttcccaagtgcacgtgcttgctgcagggtgcctggtcatgcagacagggcttccgtacacctgctgctaccctgggttctcctgagcaatactgtactgtcaagagaggcaggaagaggtggaaagaaccaagaaaagagtttgggtatggtctgtaattccaacactttgggaggctgaggtgggaggattgcttaggaccaggagttcaagaccagcctaatggatgtagtgagacccccatctctttttttcttcttttttattttttttgaaacagggtcggactctgtcgcccagactg

SEQ ID NO: 366500 - DNA, 5655 bp, Homo sapiens
  misc_feature (4272)..(4272): n is a, c, g, or t
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccacagcagccagccatggggtgcccaagaggttggttcccgttgccacttgaaatatgcaaacaggtagctagaaaccatctgggcttgacaaagtctaatgccttgaacaaataagcttatccctctgaaaacaaaatggtgcttgtaatgacccacgttaaatatgttttattggccagttaatcattgtggttgaatacttgcctaaggcggtaagaaatcaaataagtaaatcctaaaacaggaagaaaggaatcatattcattcctgaattcagaaaactaaatgaacaggccacaggtcagaagtggtgggaagcaggcccagtggatacctttagacacatgtcctagtagggatgctcgggctttgcttctctgcggac

SEQ ID NO: 366501 - DNA, 4438 bp, Homo sapiens
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcaccccgtgtctactaaaaatacaaaaattagccaggcatggtggcgggcgctggtaatcccagctactcaggtggctgaggcaggagggattgcttgaacctgggaagtggaggctgcagtgagcccagatcacgccactgcactctagcctgggcaataagagcaagactgtctcaaaataaataaataaataaataaatagtgtttctcacttgttggcccttggccctcagggatcccctgactgctccatccaattctgggccccctcctcacattacccccacccccagcatgactggtccgtcggagtcttacgctcttcaaatcggtctagctcaggggctggagccttctgtcgtgcaggaggggcctttcttttccgttcctccatgtccttccctgtggcaaagatattttggagtctttgtttctccttctccaaatcccctgtagggccaaaaagaaatggcctagttaggctgtaaagggtgcccttattcatggtctgtgttcccaagtgcacgtgcttgctgcagggtgcctggtcatgcagacagggcttccgtacacctgctgctaccctgggttctcctgagcaatactgtactgtcaagagaggcaggaagaggtggaaagaaccaagaaaagagtttgggtatggtctgtaattccaacactttgggaggctgaggtgggaggattgcttaggaccaggagttcaagaccagcctaatggatgtagtgagacccccatctctttttttcttcttttttattttttttgaaacagggtcggactctgtcgcccagactg

SEQ ID NO: 366502 - DNA, 3230 bp, Homo sapiens
  misc_feature (73)..(73): n is a, c, g, or t
  misc_feature (1847)..(1847): n is a, c, g, or t
ctgagcagacaacagcatacatccgactctcaatcttttccccacctttcccccttttctattctgctgctgntgtctgctgcagctgcagcagacacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccacagcagccagccatggggtgcccaagaggttggttcccgttgccacttgaaatatgcaaacaggtagctagaaaccatctgggcttgacaaagtctaatgccttgaacaaataagcttatccctctgaaaacaaaatggtgcttgtaatgacccacgttaaatatgttttattggccagttaatcattgtggttgaatacttgcctaaggcggtaagaaatcaaataagtaaatcctaaaacaggaagaaaggaatcatattcattcctgaattcagaaaactaaatgaacaggccacaggtcagaagtggtgggaagcaggcccagtggatacctttagacacatgtcctagtagggatgctcgggctttgcttctctgcggac

SEQ ID NO: 366503 - DNA, 2677 bp, Homo sapiens
  misc_feature (1294)..(1294): n is a, c, g, or t
ctgactgatgtgaggggagcagggccccccttccaacagagcacagcccaggagctgctccaggagggggcagtcccctactggcttctcgtgctgttagctcttgtctctgggggacttgctcttggcatcacgtttgtttcctagcagtttcgacatcttcatggtcttggacttccccttcctcttgccctcaggttcagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccacagcagccagccatggggtgcccaagaggttggttcccgttgccacttgaaatatgcaaacaggtagctagaaaccatctgggcttgacaaagtctaatgccttgaacaaataagcttatccctctgaaaacaaaatggtgcttgtaatgacccacgttaaatatgttttattggccagttaatcattgtggttgaatacttgcctaaggcggtaagaaatcaaataagtaaatcctaaaacaggaagaaaggaatcatattcattcctgaattcagaaaactaaatgaacaggccacaggtcagaagtggtgggaagcaggcccagtggatacctttagacacatgtcctagtagggatgctcgggctttgcttctctgcggac

SEQ ID NO: 366504 - DNA, 6115 bp, Homo sapiens
  misc_feature (4265)..(4265): n is a, c, g, or t
gggtctccctgccaagctatgggggaggggatggtggacatgacaacttccagctcagcggtgctttaggagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccactgcactccagcctgggcgacagagcaagactcagtctcaaaaaaaaaaaaaattagctgggcagggcatggtgatggtgcctgtaatcctagctacttgggaggctgaggcatgagaattgcctgaacccaggaggtggaggttgcagtgagccgagatcgtgccactgtactccagcctgggtgacagcgcgagactccgtctcaaaaaaagctgggtgtggggaacacctgtggtcccagctattctggagactgaggcaggaggattgcttgagctcaggagttctggctgcagtgagctatgatcatgccactgtattacagaatgggtgacagaatgagagcgacactgtctcaaaaaaaaaaaaaaaaaaaggccgggagcggtcgtttgtgcctgtaatcccaacactttgggaggccagggtgggcggatcacttgaggccaggagttcaagaccagcctggccaacatggtgaatccccatctctactaaaaaaattaactggacatggtggtggacacttgtaatcccagctactcaggaggctgacacatgagaattgcttgaacccgggaggcggaggttacagtgagccgagatagcaccactgcactccaacctgggcacagagtaaggctctgtctttaaaaaaaaaaaaaaaaaaaaagttttgtcaaaacttagcagagcaaggctaagaaagctcaggaacctggggcctcggcgatgcctgtagtggcaacttatgtataggggctgcagggagaggttaggctgtggcattgagccctgatagcccctatcatcaggaagtggtagatttcagttaatcctgagttctgga

SEQ ID NO: 366505 - DNA, 5791 bp, Homo sapiens
  misc_feature (4408)..(4408): n is a, c, g, or t
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccacagcagccagccatggggtgcccaagaggttggttcccgttgccacttgaaatatgcaaacaggtagctagaaaccatctgggcttgacaaagtctaatgccttgaacaaataagcttatccctctgaaaacaaaatggtgcttgtaatgacccacgttaaatatgttttattggccagttaatcattgtggttgaatacttgcctaaggcggtaagaaatcaaataagtaaatcctaaaacaggaagaaaggaatcatattcattcctgaattcagaaaactaaatgaacaggccacaggtcagaagtggtgggaagcaggcccagtggatacctttagacacatgtcctagtagggatgctcgggctttgcttctctgcggac

SEQ ID NO: 366506 - DNA, 5818 bp, Homo sapiens
  misc_feature (4435)..(4435): n is a, c, g, or t
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaaggtgaggcccttgctggggatgaggctgagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaataaacagacaacctcaactgccagtgccctgcagcctcgggccacagcggcagccttgtttgccttcccacctgcctctgccacacctggtggctgaacatctctggtcgcccagaggccatgttggggccatcctccaagagggatctctgccctcaccgcctgccactgggcaggatccctttcctctgcagggagaggtggctcctcggccatgcagcccctggcaggctccttctaaacatgcctgttgacctggagctggcgccaccaactccagggcctttccagggccagacaggtaacacgcatgaacccgagtgacagctctgacgggctgtttcggtgtcaggagacaaagctggcaggggcaggggtgaactggaggcaagtcaagtcacctgtggcctgtggggctgaatgtgggcccggtgttgccagatcctttgtcataagaagctagaaatccagattttatgtgtgtgtaatttgtaaatgctgaaagctagcctgaattttttttttttttttgagacagagtctcgctctgtcgcccaggctggagtgcagtggcgcgatctcagctcactgcangctccgcctcctgggttcacgccatcctcctgcctcggcctcctgagcagctgggactacaggcgcatgctacgacgcctggctaattttttgtatttttagtagagacggggtttcaccgtgttaaccaggatggtctcgatctcctgaccttgtgatccacccaccttggcctcccaaagtgctgggattacaggcgtgagccaccacgcccggccactagcctgaatttcaatcaagggttggctgatactgtgtgtccagggtggactggatttgtcctggggggttctctggtttgctgcctcctgaccacatgatggggccttcgaggtcgaggacaactgttcccattagattgcaccctctgccctcaggttcttgagggtgtgtggacacagaggctttccatgggatgtccctgagccggcccttgattggggcctcaccatttacagggccgttttattctgcaaaccgaaacttgggtcatgtgacctgatgggattatgggactccctccaggtgcccgagacaaggttgatatttccaaaatattttggtgatttagtgggacaagcaaatgacagaataccggagaaggcagggatcgtgggtgtcaggagccagaggggagggggacagatgtgctgtgtacaggacaaggtgtcaggtgactccttcccagcagggcctcgcagatgcacaagcacggagctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcattaacagagtggaattcagcacccgccacagcagccagccatggggtgcccaagaggttggttcccgttgccacttgaaatatgcaaacaggtagctagaaaccatctgggcttgacaaagtctaatgccttgaacaaataagcttatccctctgaaaacaaaatggtgcttgtaatgacccacgttaaatatgttttattggccagttaatcattgtggttgaatacttgcctaaggcggtaagaaatcaaataagtaaatcctaaaacaggaagaaaggaatcatattcattcctgaattcagaaaactaaatgaacaggccacaggtcagaagtggtgggaagcaggcccagtggatacctttagacacatgtcctagtagggatgctcgggctttgcttctctgcggac

SEQ ID NO: 366507 - DNA, 4068 bp, Homo sapiens
ggcggccgccgtcggggccaagccggggccccgaagccagagccggagccgggcgggccgcggggtcatggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggcagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggctctccacgcctcccgcctctcgcactcggagccgccctcggccacaccatcgccagcgctcagcgtggagagcctgtcgtctgagagcgccagccagactgcaggtgcagagcttctggagccgccagctgtgcccaagagctcctcagagcctgctgtccatgcccctggtacccctggaaaccctgtcagcctctctaccaactcctccctggcctcctctggggaactagtggagcctagagtggaacaaatgcctcaagccagccctggccttgcccccaggaccaggggcagctcaggtccccagccagccaagccctgcagtggcgccaccccaacgcctctcttgttggttggagacaggagcccggtgccttcccctggaagctcgtccccacagctgcaggtaaagtcctcctgcaaggagaatccttttaaccggaagccatcacctgcagcgtccccagccacaaagaaggccaccaagggatccaagccagtgaggccacctgcccctggacacggctttccactcatcaaacgcaaggtccaggctgaccagtacatccctgaggaggacatccatggagagatggataccattgagcgccggctggatgccctggagcaccgtggggtgctgctggaggagaagctgcgtggcggcctgaatgagggccgtgaggatgacatgctggtggactggttcaagctcatccacgagaagcacctactggtgcggcgagagtccgagctcatctatgtcttcaagcagcagaacctggagcagcgccaggctgatgtcgagtatgagctccggtgcctcctcaataagccagaaaaggactggacggaggaggaccgggcccgggagaaggtgctgatgcaggagcttgtgaccctcattgagcagcgcaacgctatcatcaactgcctggatgaggaccggcagagggaggaagaggaagacaagatgttggaagccatgatcaagaagaaagagttccagagggaggctgaacctgagggcaagaagaaggggaagttcaagaccatgaagatgttgaaactgctaggaaacaaacgtgatgccaagagcaagtcccccagagacaagagctaacagcacgagaagccagttggggactgccccctcctggagcagctcctgggctgtgctctgtttgaagggggcgccctgctcccctcagatcagtcaggaggaagatgactaaggggagggatcctctgggtgatggcctcttcctcctcagggacctctgactgctctgggccaaagaatctcttgtttcttctccgagccccaggcagcggtgattcagccctgcccaacctgattctgatgactgcggatgctgtgacggacccaaggggcaaatagggtcccagggtccagggaggggcgcctgctgagcacttccgcccctcaccctgcccagcccctgccatgagctctgggctgggtctccgcctccagggttctgctcttccaggcaggccagcaagtggcgctgggccacactggcttcttcctgccccatccctggctctgagtctctgtcttcctgtcctgtgcaggcgcccttggatctcagtttccctcactcaggaactctgtttctgaagtcttcagttaagtttgagtttatgactgagtggcctgtactgtcagacgtgaatgggcctgacgggcaaatccatccctctctccctcacagttccaggagcggcttccctcgtctccccttactccacagggagcctcccttgccaggaccagggctgcgacggccatgctggggcaggtgagtgctctgttagctgctcccagtgctgtccccaggctgcagttctggtccctggttgtcaggtaggaagggtgcacttgaagcaggtgctcatctcggttccttaacgtttatagtctgacccctcacttaggctttcctctgccaccccggtccagggaagaggctcgctcccgcccatggtcatcactggtctgtctgctctgttgtctgttctttccctgactccctcccaccgaaggcctgatggctactcaccccgtgtctactaaaaatacaaaaattagccaggcatggtggcgggcgctggtaatcccagctactcaggtggctgaggcaggagggattgcttgaacctgggaagtggaggctgcagtgagcccagatcacgccactgcactctagcctgggcaataagagcaagactgtctcaaaataaataaataaataaataaatagtgtttctcacttgttggcccttggccctcagggatcccctgactgctccatccaattctgggccccctcctcacattacccccacccccagcatgactggtccgtcggagtcttacgctcttcaaatcggtctagctcaggggctggagccttctgtcgtgcaggaggggcctttcttttccgttcctcccaaagtgctggaattacaggcatgagccatcacgcctgaccgatatcctatctct

SEQ ID NO: 366508 - DNA, 689 bp, Homo sapiens
tccagcctggacaacaagagtgagactccatctcaaaaaaacaaaacaaaacaaaatgaaaacaaaacacaaaacaacacctgattgggtaaaaaccactgctttattttcctgagccactactggatgcagccactcactggatgccacctctcagggggacctttgcttcttcctcttgcagcataaactgaaggcatttttcacaatttctgttgctgagttcgtgtgatttggtgattttattgttccactatgcttctgacagttactgttttctttatcctctgggaagtctagggtatggagtcgagcttggctggcagttgggaggagggaagggaggagacagccctgggtgcggctggaggggtagccagtgcctgggcccagctgcctggctaagtgaacccctgtcctgtcccctgccaggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgagg

SEQ ID NO: 366509 - DNA, 1277 bp, Homo sapiens
  misc_feature (19)..(20): n is a, c, g, or t
  misc_feature (22)..(22): n is a, c, g, or t
  misc_feature (28)..(28): n is a, c, g, or t
ctactactactaaattcgnngncgcgtngacagagcagcttatgggaactacataggctggaaatgaccctcctgagaatgtagctggctacaaagcatttcatttcacatacttgattgactgtcacctcctctcactgactcttgattatgttacaggaattatttcacaagctgattgttttttcccgtggattgttttcatagctttcacccaggctgctagagcgtggtctacatttcttttctttctttcttttttttcctttgggacaaggtcattctgttgcccaggctggagtgcagtggtgcgatcgcggctcactgcaggcttgacctccctgggctcaggtgatcctcccaccccagcctttctcgtagctaaaactgcaggcacgtgccaccatgcccagctaatttttttcaatttttggtagagacgggattttgctatgttacccaggctggtctcaaactcctgggcctaagggatccgcccacttctgcctcccagagtgctgggattacaggcgtgagccactgcacccagcctgagtatggtctatatttctgttggttaagatgttaaattcagtgatgttaaaacttattacatctactttaactttgataataggcataatgggaattaaataatcaggagaagacagtcttgtctttaggtcagaagtacttagaaataaaacttggaggattggtggaacaaaaaaaaaaagttaattcattctttatgcccctcagctaactgatattatttagtttattaagcaagatgactttgtttacttcatgctatgtggggtgattggttccccagggcatagttgcctttgtagttttgctaggcacattggagaaaatgataaggatttttctatttgcctagagcaggtggtctcttaatctttgttgtttagaacaagaacatgtttcttggttgtcaaagtggtggcagggtatttgaaaccagaaaaaccagcatttaagaaaaaaatcgggccaggcgtggtggctcacgcctgtaatcccagcactttgggaggcggagatgtgcggatcacgaggtcaggagattgagaccatcctggctaacacggtgaaaccccgtctctactaaaaatacaaaaaaattagctgggtgtggtggcgggtgcctgtagtctcagctactcaggaggctgaggcaggagaatggcatgaacctgggagggggagcttgcagtgagctgagattgcaccactgcactccagcctgg

SEQ ID NO: 366510 - DNA, 666 bp, Homo sapiens
acagaaaacagaatatgtttacaaatacacaagaaatagaacggagaacagaaaaaaaaacaaaaacaaaaaaaaacaaaaaaaaaaaaagaaaaaaaaaaaaaaaaaaaaaaaaaaaaaaaaaagttaattcattctttatgcccctcagctaactgatattatttagtttattaagcaagatgactttgtttacttcatgctatgtggggtgattggttccccagggcatagttgcctttgtagttttgctaggcacattggagaaaatgataaggatttttctatttgcctagagcaggtggtctcttaatctttgttgtttagaacaagaacatgtttcttggttgtcaaagtggtggcagggtatttgaaaccagaaaaaccagcatttaagaaaaaaatcgggccaggcgtggtggctcacgcctgtaatcccagcactttgggaggcggagatgtgcggatcacgaggtcaggagattgagaccatcctggctaacacggtgaaaccccgtctctactaaaaatacaaaaaaattagctgggtgtggtggcgggtgcctgtagtctcagctactcaggaggctgaggcaggagaatggcatgaacctgggagggggagcttgcagtgagctgagattgcaccactgcactccagcctgg

SEQ ID NO: 366511 - DNA, 564 bp, Homo sapiens
agtagaggggcaccacaaactgtgcccgtataagacaagaacttaataagtatagtgtgtgtaatgactactctaccatccagacattccagaggctctttggtctctctcttggctgagggaatttgggcataagcaggctgcaccctctggctaaataactcagcatcatgagggtggacctgagggtttaaagtagctctcattatatagatcctggatgttgagggttctctctcccacccccgcatccccagctcttaaaccctaacctcttactatttccatgacaactggcttcaattcaagccatttggctcagaaaaggttgagttagggtgatgatgggttagaaactaaacttcatgtgtccgccctcttgccctttactcccattcccaaccctggaggctttatacaagtgcttaagtgagtaggtgttggggagagcagggtttggggaataagggataaacggggcacagtgggcaggggccctcctattccagtaaagccaaataccaaaaaaatgaaaagtcacaataaataaataaataaaaattc

SEQ ID NO: 366512 - DNA, 1240 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366513 - DNA, 1334 bp, Homo sapiens
taagcatctggcttttattggttgcctttcttaaacccagcattttttaaaaagtcacctgaggtggtagtttagtcagggctggagaaaggggtaggccagtggtcagtcgggaggagggtacgcggggaggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366514 - DNA, 3210 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttcagaggggcactggccaggtccacacacatcataaggtgggagggggtgctaactcccactgggttgctgagctgtgccccccaagtcccttcactctgtgcctctttgggggtagggaggaacaggggaatgagacttcagctcacagatttatgttcataagagaaagacccctgccccccccccacccaccacacacacacaaaggtctttatttggtggtatttaaggagctgtattctaagtgtcccccatatttaatgccccagctctctagaatctgtagagggaagatacctgatgcttattgcccaatccctactctgccaagatcacgaggcatttgaccttggagggaggtatctgttcttcacttctctgttcctttccttccaccaaggaaatgtgagtggtgttgatggccgggtgtgtcttgtccttcaggattggggcagaaggaaggatgaagaacagggccagagaggcttggggttagcatagctgctatatgggtgaaggcaagctgaagagcctaacagccctgcccattcctctactgaaagatcttgtttcactttctcactataagaataggaataagatgttaaagctcaccaacatcaccttctcaagggtggtcacatacctttgccccttccaccaactggccaagggggagagtcatgctcttgggaagaatgagccatccagttttgctcaccagcttgggctttactttagttcagtactgtttttatcagacccgtaactgctggctctacttagagtgacagttttgctgaagattcttacccccacctctcctgacatcctctaagctcttgcctggagccaagaggcctggtggtgaagtaaggatagggtgtggatcaggagattctcaactccttggcttctaggcactgtccagctgggaggcagaggggaacttgtactctgaagcctgtgactcctcttaagcctcacatctcttcaccactactctggtgccctggttatctgtcccacagcgagaggtattttatgtccataaagtgcccgtggtaagtgctcagaattcatctcttggctgtggcgggtgctgtcatttctcattccattgaggggaagaaactgaggcacagtgagtccagaggagaatgggtcagggttgtgggaggaatgaatgggcctagctagtgacttgaaatggcaaccagtctctgcctgcttcctagccttccaagcccgggagtctccatccttcccatcctctgttctaactggccttgtcagatgcttttccccactgtactttcccctccctgctgccaggtactgttagattccaaaaataaaaggaaaaaataattatacactctgcttccttgttctcccctcttccaccctgagctttggggttaggagactaaaatgtcccccttccagaatccttcccaccttggtctgctggctctattccctagcccagagcagtgatttggattcaaatgccctgtaaccttcagcctccttactgctcctttcttgacctctcctaacgctttccagacccaggggactctggggtctctatactctctctaattgacctgaagatagaggctgggagcagggccattccagaggctctttggtctctctcttggctgagggaatttgggcataagcaggctgcaccctctggctaaataactcagcatcatgagggtggacctgagggtttaaagtagctctcattatatagatcctggatgttgagggttctctctcccacccccgcatccccagctcttaaaccctaacctcttactatttccatgacaactggcttcaattcaagccatttggctcagaaaaggttgagttagggtgatgatgggttagaaactaaacttcatgtgtccgccctcttgccctttactcccattcccaaccctggaggctttatacaagtgcttaagtgagtaggtgttggggagagcagggtttggggaataagggataaacggggcacagtgggcaggggccctcctattccagtaaagccaaataccaaaaaaatgaaaagtcacaataaataaataaataaaaattc

SEQ ID NO: 366515 - DNA, 1918 bp, Homo sapiens
gaagggctgagttggacttttctaggaactgaattctacagggtagcttgcgcctttcctacgtcttctccgtgcagccttttccacttcgtttctcggctcccgccgtagctcttttgtgccacccttccacactacgccttccctaatttcccatttctcctcacggctttactgctatatttatttgttatttctgcttccttcatcattgtatcgtccgtcacccttccccactgggttgtgtaagtgccttctacctgttatactcttcgttgcttttcagggctgcattacgtcagttggtccctcctttttgccccatgtcggagccaggatccgtttttcttccctgggatgatgtttccagtctgtcgtccgaagctgagatttccctgttagcaaatggtggcatttttgtgtatttctgtctaaataggtaccagacactcagaaaatacttccactccccttttctaggtgggattacgccccaagccgaattttgaaacagggagaggcctctcagaagatcggtctcgccttagaagcctggggttgaggaggtcttgagaatagtagaagtacagacacctcagatttaaaagttttcgagttctgtcacgcggctctcggcccgccagccttcctcacacaccatctccaaccaccagagagaactcacacctgcaatatttgggaaaaacaattccaagagcacttcttaaccttttggaggtcacagatatctttgaaactctgatgaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366516 - DNA, 1106 bp, Homo sapiens
ctagagttccatatcttcgctcatatactctccttcaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366517 - DNA, 1062 bp, Homo sapiens
ggtctgtggataagatcttgctttattcccttggtctccaggcatatcttgaagaacatggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366518 - DNA, 910 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgccctcccattaaggagccaggacccccgggtcaacccttaacttcggccaccggtttgcttaatgctggttcaaccttaagggtggtggggttttggttttgaatatggtgcctggttata

SEQ ID NO: 366519 - DNA, 3675 bp, Homo sapiens
ggttgcgtgtgttttgattctgtgttttcttgtttttcctctgcctgcgctgtttctcttcactttttctttctctcgtgtattatcacctggcattacgcggattcggttggtaccttccctaatgtattgtgctggctaattgtggtgttgtccatttggccagcccggagtaggtcttccaagatgccagctggccgtcttcccatcgggcggtggtaaaccgcgccctgtctctgctttttattcgtcccccaatggggccacctggaccaagaaagcggatggcttaaattggggcccccggggatattttttacccccccccttttttttttttttttttttttttggagatgggagtctcactctgtcaccatgctagagtgcagtggtgcgatctcagctcactgcaacctccgccacctgggttcaagcgattcttctgcctcagccttccatgtagctgggattacaggcgcacgccaccacgcccggctaattttgggtattttagtagagatgaggtttcacaatgttggccagcatggtctcgaactccggaccttgcatgatccgcccgcctcggccccccaaagtgctgggattacagatgtaagccactgcgcccagccagctttccttatttttgaaaaatgtgagtcaggcaatattcttttgccattcccaactcatattcctggggaattgtgctctaggtacatgggaaaaatttttacagtgaactgaaagaatatttgagatgctattttagccactcttgtgtaacaaggcaagttcgttggctatgttggtttagatttttgtcaaacttcgttgaggaaacctaggaacagggactgcaggagaataggacactagctggatcatctcaagagaacctttagatcttccatactagctggatcatctcaagagaacctttagatcttccattctgtggaggctgggagaggggtcttgttgtctttgggactgttttggctcaagcttttcagagaggggttgttctaggtacccccagtttcctgtcctctttccatccttccttggcctgcatgtcccaaaccttataccaccatgcccttagtgttttctgtcttgctccaggaccccatcttcttagtcattgaacacgaggtttcctgtctcagatcctcttcacctccggttctccaaggtgtaaatgtggcacttgattagggagaagagctcagcactgaattctaaactctttgaccgcttttattttttttttcaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttcagaggggcactggccaggtccacacacatcataaggtgggagggggtgctaactcccactgggttgctgagctgtgccccccaagtcccttcactctgtgcctctttgggggtagggaggaacaggggaatgagacttcagctcacagatttatgttcataagagaaagacccctgccccccccccacccaccacacacacacaaaggtctttatttggtggtatttaaggagctgtattctaagtgtcccccatatttaatgccccagctctctagaatctgtagagggaagatacctgatgcttattgcccaatccctactctgccaagatcacgaggcatttgaccttggagggaggtatctgttcttcacttctctgttcctttccttccaccaaggaaatgtgagtggtgttgatggccgggtgtgtcttgtccttcaggattggggcagaaggaaggatgaagaacagggccagagaggcttggggttagcatagctgctatatgggtgaaggcaagctgaagagcctaacagccctgcccattcctctactgaaagatcttgtttcactttctcactataagaataggaataagatgttaaagctcaccaacatcaccttctcaagggtggtcacatacctttgccccttccaccaactggccaagggggagagtcatgctcttgggaagaatgagccatccagttttgctcaccagcttgggctttactttagttcagtactgtttttatcagacccgtaactgctggctctacttagagtgacagttttgctgaagattcttacccccacctctcctgacatcctctaagctcttgcctggagccaagaggcctggtggtgaagtaaggatagggtgtggatcaggagattctcaactccttggcttctaggcactgtccagctgggaggcagaggggaacttgtactctgaagcctgtgactcctcttaagcctcacatctcttcaccactactctggtgccctggttatctgtcccacagcgagaggtattttatgtccataaagtgcccgtggtaagtgctcagaattcatctcttggctgtggcgggtgctgtcatttctcattccattgaggggaagaaactgaggcacagtgagtccagaggagaatgggtcagggttgtgggaggaatgaatgggcctagctagtgacttgaaatggcaaccagtctctgcctgcttcctagccttccaagcccgggagtctccatccttcccatcctctgttctaactggccttgtcagatgcttttccccactgtactttcccctccctgctgccaggtactgttagattccaaaaataaaaggaaaaaataattatacactctgcttccttgttctcccctcttccaccctgagctttggggttaggagactaaaatgtcccccttccagaatccttcccaccttggtctgctggctctattccctagcccagagcagtgatttggattcaaatgccctgtaaccttcagcctccttactgctcctttcttgacctctcctaacgctttccagacccaggggactctggggtctctatactctctctaattgacctgaagatagaggctgggagcagggccattccagaggctctttggtctctctcttggctgagggaatttgggcataagcaggctgcaccctctggctaaataactcagcatcatgagggtggacctgagggtttaaagtagctctcattatatagatcctggatgttgagggttctctctcccacccccgcatccccagctcttaaaccctaacctcttactatttccatgacaactggcttcaattcaagccatttggctcagaaaaggttgagttagggtgatgatgggttagaaactaaacttcatgtgtccgccctcttgccctttactcccattcccaaccctggaggctttatacaagtgcttaagtgagtaggtgttggggagagcagggtttggggaataagggataaacggggcacagtgggcaggggccctcctattccagtaaagccaaataccaaaaaaatgaaaagtcacaataaataaataaataaaaattc

SEQ ID NO: 366520 - DNA, 839 bp, Homo sapiens
  misc_feature (16)..(16): n is a, c, g, or t
  misc_feature (68)..(68): n is a, c, g, or t
ggagagtaagaaagcngctcgggcagctagggttgggatttcttcagttccaacaaaaggtctgtcantctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366521 - DNA, 3000 bp, Homo sapiens
catctccttcacctctatgaatagcattggttaatcctttatcctctgaaatcttccgtctccccattgactggaagacttttcccagcctgttaagagcccattgtttccaggctagcttgatctcaggctgagtggctctctttgcttcaggaatcttcccattttctaccactgttcttctctctgtccctcacccccagtaatcttctttactcctcaccctccttacccattaaactttccagctcctactggataactggaaggattggagagattcaggaatgaaatctctagctaccaagctcaagtctgggccatccttccttctcgggccttgtgacagttcatgtgagtttggattaaagcagccaggaacccaggcaactattgtcttcagtctaatttttttcttcttgcttcttctttacaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttcagaggggcactggccaggtccacacacatcataaggtgggagggggtgctaactcccactgggttgctgagctgtgccccccaagtcccttcactctgtgcctctttgggggtagggaggaacaggggaatgagacttcagctcacagatttatgttcataagagaaagacccctgccccccccccacccaccacacacacacaaaggtctttatttggtggtatttaaggagctgtattctaagtgtcccccatatttaatgccccagctctctagaatctgtagagggaagatacctgatgcttattgcccaatccctactctgccaagatcacgaggcatttgaccttggagggaggtatctgttcttcacttctctgttcctttccttccaccaaggaaatgtgagtggtgttgatggccgggtgtgtcttgtccttcaggattggggcagaaggaaggatgaagaacagggccagagaggcttggggttagcatagctgctatatgggtgaaggcaagctgaagagcctaacagccctgcccattcctctactgaaagatcttgtttcactttctcactataagaataggaataagatgttaaagctcaccaacatcaccttctcaagggtggtcacatacctttgccccttccaccaactggccaagggggagagtcatgctcttgggaagaatgagccatccagttttgctcaccagcttgggctttactttagttcagtactgtttttatcagacccgtaactgctggctctacttagagtgacagttttgctgaagattcttacccccacctctcctgacatcctctaagctcttgcctggagccaagaggcctggtggtgaagtaaggatagggtgtggatcaggagattctcaactccttggcttctaggcactgtccagctgggaggcagaggggaacttgtactctgaagcctgtgactcctcttaagcctcacatctcttcaccactactctggtgccctggttatctgtcccacagcgagaggtattttatgtccataaagtgcccgtggtaagtgctcagaattcatctcttggctgtggcgggtgctgtcatttctcattccattgaggggaagaaactgaggcacagtgagtccagaggagaatgggtcagggttgtgggaggaatgaatgggcctagctagtgacttgaaatggcaaccagtctctgcctgcttcctagccttccaagcccgggagtctccatccttcccatcctctgttctaactggccttgtcagatgcttttccccactgtactttcccctccctgctgccaggtactgttagattccaaaaataaaaggaaaaaataattatacactctgcttccttgttctcccctcttccaccctgagctttggggttaggagactaaaatgtcccccttccagaatccttcccaccttggtctgctggctctattccctagcccagagcagtgatttggattcaaatgccctgtaaccttcagcctccttactgctcctttcttgacctctcctaacgctttccagacccaggggactctggggtctctatactctctctaattgacctgaagatagaggctgggagcagggccattccagaggctctttggtctctctcttggctgagggaatttgggcataagcaggctgcaccctctggctaaataactcagcatcatgagggtggacctgagggtttaaagtagctctcattatatagatcctggatgttgagggttctctctcccacccccgcatccccagctcttaaaccctaacctcttactatttccatgacaactggcttcaattcaagccatttggctcagaaaaggttgagttagggtgatgatgggttagaaactaaacttcatgtgtccgccctcttgccctttactcccattcccaaccctggaggctttatacaagtgcttaagtgagtaggtgttggggagagcagggtttggggaataagggataaacggggcacagtgggcaggggccctcctattccagtaaagccaaataccaaaaaaatgaaaagtcacaataaataaataaataaaaattc

SEQ ID NO: 366522 - DNA, 1841 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaaggtaatgtaggctcgatggaagtaatgtttttgtgacattagagcagcttatgggaactacataggctggaaatgaccctcctgagaatgtagctggctacaaagcatttcatttcacatacttgattgactgtcacctcctctcactgactcttgattatgttacaggaattatttcacaagctgattgttttttcccgtggattgttttcatagctttcacccaggctgctagagcgtggtctacatttcttttctttctttcttttttttcctttgggacaaggtcattctgttgcccaggctggagtgcagtggtgcgatcgcggctcactgcaggcttgacctccctgggctcaggtgatcctcccaccccagcctttctcgtagctaaaactgcaggcacgtgccaccatgcccagctaatttttttcaatttttggtagagacgggattttgctatgttacccaggctggtctcaaactcctgggcctaagggatccgcccacttctgcctcccagagtgctgggattacaggcgtgagccactgcacccagcctgagtatggtctatatttctgttggttaagatgttaaattcagtgatgttaaaacttattacatctactttaactttgataataggcataatgggaattaaataatcaggagaagacagtcttgtctttaggtcagaagtacttagaaataaaacttggaggattggtggaacaaaaaaaaaaagttaattcattctttatgcccctcagctaactgatattatttagtttattaagcaagatgactttgtttacttcatgctatgtggggtgattggttccccagggcatagttgcctttgtagttttgctaggcacattggagaaaatgataaggatttttctatttgcctagagcaggtggtctcttaatctttgttgtttagaacaagaacatgtttcttggttgtcaaagtggtggcagggtatttgaaaccagaaaaaccagcatttaagaaaaaaatcgggccaggcgtggtggctcacgcctgtaatcccagcactttgggaggcggagatgtgcggatcacgaggtcaggagattgagaccatcctggctaacacggtgaaaccccgtctctactaaaaatacaaaaaaattagctgggtgtggtggcgggtgcctgtagtctcagctactcaggaggctgaggcaggagaatggcatgaacctgggagggggagcttgcagtgagctgagattgcaccactgcactccagcctgg

SEQ ID NO: 366523 - DNA, 1150 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366524 - DNA, 828 bp, Homo sapiens
ttatgtatcttatctctttatgtgatccttagttcttggcacagggttggttagcaccttgtgaccaataagttatcatttcattcccatttacttggtgaatggaggctagtttgtttcaactctttcctttgtccttgaacatctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366525 - DNA, 670 bp, Homo sapiens
  misc_feature (570)..(570): n is a, c, g, or t
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaagtctgaagatgatgagaaactgaaaaagaggaaggagcgatttgggattgtcacaagttcagctggaactggaaccacagaggatacagaggaggccaaagaggaggaanagagccggagcgccttttgggattggccttggaaggaaagagtcccctggaacccccttttctggtttccttcccagggttttccccaatttccttcctc

SEQ ID NO: 366526 - DNA, 1030 bp, Homo sapiens
catctccttcacctctatgaatagcattggttaatcctttatcctctgaaatcttccgtctccccattgactggaagacttttcccagcctgttaagagcccattgtttccaggctagcttgatctcaggctgagtggctctctttgcttcaggaatcttcccattttctaccactgttcttctctctgtccctcacccccagtaatcttctttactcctcaccctccttacccattaaactttccagctcctactggataactggaaggattggagagattcaggaatgaaatctctagctaccaagctcaagtctgggccatccttccttctcgggccttgtgacagttcatgtgagtttggattaaagcagccaggaacccaggcaactattgtcttcagtctaatttttttcttcttgcttcttctttacaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366527 - DNA, 1440 bp, Homo sapiens
  misc_feature (16)..(16): n is a, c, g, or t
  misc_feature (68)..(68): n is a, c, g, or t
ggagagtaagaaagcngctcgggcagctagggttgggatttcttcagttccaacaaaaggtctgtcantctgataacaaacctatggttaacttggataagctgaaggaaagagctcaaagatttggtttgaatgtctcttcaatctccagaaaggtaatgtaggctcgatggaagtaatgtttttgtgacattagagcagcttatgggaactacataggctggaaatgaccctcctgagaatgtagctggctacaaagcatttcatttcacatacttgattgactgtcacctcctctcactgactcttgattatgttacaggaattatttcacaagctgattgttttttcccgtggattgttttcatagctttcacccaggctgctagagcgtggtctacatttcttttctttctttcttttttttcctttgggacaaggtcattctgttgcccaggctggagtgcagtggtgcgatcgcggctcactgcaggcttgacctccctgggctcaggtgatcctcccaccccagcctttctcgtagctaaaactgcaggcacgtgccaccatgcccagctaatttttttcaatttttggtagagacgggattttgctatgttacccaggctggtctcaaactcctgggcctaagggatccgcccacttctgcctcccagagtgctgggattacaggcgtgagccactgcacccagcctgagtatggtctatatttctgttggttaagatgttaaattcagtgatgttaaaacttattacatctactttaactttgataataggcataatgggaattaaataatcaggagaagacagtcttgtctttaggtcagaagtacttagaaataaaacttggaggattggtggaacaaaaaaaaaaagttaattcattctttatgcccctcagctaactgatattatttagtttattaagcaagatgactttgtttacttcatgctatgtggggtgattggttccccagggcatagttgcctttgtagttttgctaggcacattggagaaaatgataaggatttttctatttgcctagagcaggtggtctcttaatctttgttgtttagaacaagaacatgtttcttggttgtcaaagtggtggcagggtatttgaaaccagaaaaaccagcatttaagaaaaaaatcgggccaggcgtggtggctcacgcctgtaatcccagcactttgggaggcggagatgtgcggatcacgaggtcaggagattgagaccatcctggctaacacggtgaaaccccgtctctactaaaaatacaaaaaaattagctgggtgtggtggcgggtgcctgtagtctcagctactcaggaggctgaggcaggagaatggcatgaacctgggagggggagcttgcagtgagctgagattgcaccactgcactccagcctgg

SEQ ID NO: 366528 - DNA, 1546 bp, Homo sapiens
ggttgcgtgtgttttgattctgtgttttcttgtttttcctctgcctgcgctgtttctcttcactttttctttctctcgtgtattatcacctggcattacgcggattcggttggtaccttccctaatgtattgtgctggctaattgtggtgttgtccatttggccagcccggagtaggtcttccaagatgccagctggccgtcttcccatcgggcggtggtaaaccgcgccctgtctctgctttttattcgtcccccaatggggccacctggaccaagaaagcggatggcttaaattggggcccccggggatattttttacccccccccttttttttttttttttttttttttggagatgggagtctcactctgtcaccatgctagagtgcagtggtgcgatctcagctcactgcaacctccgccacctgggttcaagcgattcttctgcctcagccttccatgtagctgggattacaggcgcacgccaccacgcccggctaattttgggtattttagtagagatgaggtttcacaatgttggccagcatggtctcgaactccggaccttgcatgatccgcccgcctcggccccccaaagtgctgggattacagatgtaagccactgcgcccagccagctttccttatttttgaaaaatgtgagtcaggcaatattcttttgccattcccaactcatattcctggggaattgtgctctaggtacatgggaaaaatttttacagtgaactgaaagaatatttgagatgctattttagccactcttgtgtaacaaggcaagttcgttggctatgttggtttagatttttgtcaaacttcgttgaggaaacctaggaacagggactgcaggagaataggacactagctggatcatctcaagagaacctttagatcttccatactagctggatcatctcaagagaacctttagatcttccattctgtggaggctgggagaggggtcttgttgtctttgggactgttttggctcaagcttttcagagaggggttgttctaggtacccccagtttcctgtcctctttccatccttccttggcctgcatgtcccaaaccttataccaccatgcccttagtgttttctgtcttgctccaggaccccatcttcttagtcattgaacacgaggtttcctgtctcagatcctcttcacctccggttctccaaggtgtaaatgtggcacttgattagggagaagagctcagcactgaattctaaactctttgaccgcttttattttttttttcaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataa

SEQ ID NO: 366529 - DNA, 898 bp, Homo sapiens
  misc_feature (5)..(5): n is a, c, g, or t
  misc_feature (9)..(9): n is a, c, g, or t
  misc_feature (35)..(35): n is a, c, g, or t
  misc_feature (48)..(48): n is a, c, g, or t
  misc_feature (53)..(53): n is a, c, g, or t
  misc_feature (63)..(63): n is a, c, g, or t
  misc_feature (66)..(66): n is a, c, g, or t
tacgntctntgcctcgtctgtctcttctgcctctntctttgccttctnactgntgctcttttngtncctctgtcactatcactgtctctacatctctctgtctttttgtcaaaccttctcatctgcaaacttcaaacactccccaccctgactatgcctctgcttccttgttctcccctcttccaccctgagctttggggttaggagactaaaatgtcccccttccagaatccttcccaccttggtctgctggctctattccctagcccagagcagtgatttggattcaaatgccctgtaaccttcagcctccttactgctcctttcttgacctctcctaacgctttccagacccaggggactctggggtctctatactctctctaattgacctgaagatagaggctgggagcagggccattccagaggctctttggtctctctcttggctgagggaatttgggcataagcaggctgcaccctctggctaaataactcagcatcatgagggtggacctgagggtttaaagtagctctcattatatagatcctggatgttgagggttctctctcccacccccgcatccccagctcttaaaccctaacctcttactatttccatgacaactggcttcaattcaagccatttggctcagaaaaggttgagttagggtgatgatgggttagaaactaaacttcatgtgtccgccctcttgccctttactcccattcccaaccctggaggctttatacaagtgcttaagtgagtaggtgttggggagagcagggtttggggaataagggataaacggggcacagtgggcaggggccctcctattccagtaaagccaaataccaaaaaaatgaaaagtcacaataaataaataaataaaaattc

SEQ ID NO: 366530 - DNA, 716 bp, Homo sapiens
gcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaaaaaaaaaaaaaaaaaaaaaaattgcggccgccaatttttttttttttttttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366531 - DNA, 497 bp, Homo sapiens
aatcacatttgcttgtctttgctttttctctagagcacttcttaaccttttggaggtcacagatatctttgaaactctgatgaaaggtatggaccctctccccagaaaaaggcatgtacacatattttgcatgcagtttgaggggcttcataaaactaccttgtagccccgaggagtccatggacctctggttaagaactcatgcctttagctgggcgtggtggctcacgtctgtaatcctagcactttgggaggcctaggcgggcggattgcttgaggccaggagttcgagaccagcctgggcaacatggcgaaaccccgcctctaccaaaaatgcaaaaattagccaggtgtggtggcaagtgcctgtagtcccagctattgaggaggctgtgaggaggctgaggcacaagaatcgcttgagcccgggttggaggttgcagtgagccgagatggtgtactgcactccagcctgggggacagtgagactccgtctc

SEQ ID NO: 366532 - DNA, 344 bp, Homo sapiens
ggcagtaatttgggatggaacttcatttcctttttttcttttccttgtgggaactaccattttattcactggtgttcatcctgttaactaaggaaaagttttatttttttcccctcagcttgccgaactaaagcaagaatgtcttgctcgtggtttggagaccaagggaataaagcaagatcttatccacagactccaggcatatcttgaagaacatgctgagtactttgtggaggcggagtgatgtgagtgaggggattttcaggctttgacactgaaaagatttcttttttttttttcaggtcattagcaatgtaagctcttaattaacggcatcaagaaaa

SEQ ID NO: 366533 - DNA, 1246 bp, Homo sapiens
cccccccccgaaccaattacggtcgtagcgaggctgggtggcgggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366534 - DNA, 1081 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataa

SEQ ID NO: 366535 - DNA, 1461 bp, Homo sapiens
cctttttcccccctcagaatatttagaaataactagagatttgtgacagttagtaggtatacaaatagatgaggttttttattaaagtgtgatgtttattcttcagcatctgttaggcagttcctcttgtatattgaatatcgttagaggaaaatggatcatctttgtggacctagagccttggtagaattaagggcagtaatttgggatggaacttcatttcctttttttcttttccttgtgggaactaccattttattcactggtgttcatcctgttaactaaggaaaagttttatttttttcccctcagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366536 - DNA, 1162 bp, Homo sapiens
  misc_feature (1149)..(1149): n is a, c, g, or t
  misc_feature (1154)..(1154): n is a, c, g, or t
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataaaaaaaaaaacaccaccccttgggtttttatgcaagggtgagggggactcccccccccccccccccccnccccnccccccga

SEQ ID NO: 366537 - DNA, 1535 bp, Homo sapiens
  misc_feature (764)..(764): n is a, c, g, or t
cccccccccgaaccaattacggtcgtagcgaggctgggtggcgggagtgaggggtaacaagatggcgaccgagacggtggagctccataagctaaaggtgggattacgccccaagccgaattttgaaacagggagaggcctctcagaagatcggtctcgccttagaagcctggggttgaggaggtcttgagaatagtagaagtacagacacctcagatttaaaagttttcgagttctgtcacgcggctctcggcccgccagccttcctcacacaccatctccaaccaccagagagaactcacacctgcaatatttgggaaaaacaattccaagagcacttcttaaccttttggaggtcacagatatctttgaaactctgatgaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggttgggatttcttcagttccaacaaaaggtctgtcantctgataacaaacctatggttaacttggataagctgaaggaaagagctcaaagatttggtttgaatgtctcttcaatctccagaaagtctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggtacatccatgaactgcggcagcagtttgacttattgctgtttcagctttaaggttgttgtgtttttgtttttgattatgttgcttgttaataaaaaaaaatagaaaagagaaaaaaaaactcttcgcaaaggctattcttatttggcgttgcggaagaaaaagaggtctttgaattgccacctggttcttagtctgtttcctgacccaatttttttgtttcaagcggtaggatttgccgggtcccctatagggagagcgtattaatttgcaataagccggttaactttatattggttggccagagagaccgccgggataacgccataaagcgcgtttgtgcggccacaaccctatctacactcgttactcgagacactggtctgcacagaacacgcttactctgcgtttgttgtctcatcac

SEQ ID NO: 366538 - DNA, 2737 bp, Homo sapiens
ttgaatgagtggttgacacacacgagagaaaagagaggagagggctagctggcgacgactctcttaatctaccaccgctacactctgaagatgatgagaaactgaaaaagaggaaggagcgatttgggattgtcacaagttcagctggaactggaaccacagaggatacagaggcaaagaagaggaaaagagcagagcgctttgggattgcctgatgaaaagttcctgatactttctgttctccagtgttttccatttctctccttcttcttggtcacatatatgcctaaatgcacagtcatgtgcctacgtcctgcctcgcaatgagggagcatgtaccccaggttcaagtgctggattgtgtcatgtgaccatcccaaaactcagagcaccctatggccgtctttgccctctgtcacataacttgaaaactgcctgatggcctttttgcagtggttccctccaggaagccttgatctcagttgaagaagttctttcctggcattccaatgcccctgtcagctccatactcctcagacacccttaacaaaggctgtcatgcacacaatgtgacaaatacacaaaataaatgataattacactaataatgatatgttcagaggggcactggccaggtccacacacatcataaggtgggagggggtgctaactcccactgggttgctgagctgtgccccccaagtcccttcactctgtgcctctttgggggtagggaggaacaggggaatgagacttcagctcacagatttatgttcataagagaaagacccctgccccccccccacccaccacacacacacaaaggtctttatttggtggtatttaaggagctgtattctaagtgtcccccatatttaatgccccagctctctagaatctgtagagggaagatacctgatgcttattgcccaatccctactctgccaagatcacgaggcatttgaccttggagggaggtatctgttcttcacttctctgttcctttccttccaccaaggaaatgtgagtggtgttgatggccgggtgtgtcttgtccttcaggattggggcagaaggaaggatgaagaacagggccagagaggcttggggttagcatagctgctatatgggtgaaggcaagctgaagagcctaacagccctgcccattcctctactgaaagatcttgtttcactttctcactataagaataggaataagatgttaaagctcaccaacatcaccttctcaagggtggtcacatacctttgccccttccaccaactggccaagggggagagtcatgctcttgggaagaatgagccatccagttttgctcaccagcttgggctttactttagttcagtactgtttttatcagacccgtaactgctggctctacttagagtgacagttttgctgaagattcttacccccacctctcctgacatcctctaagctcttgcctggagccaagaggcctggtggtgaagtaaggatagggtgtggatcaggagattctcaactccttggcttctaggcactgtccagctgggaggcagaggggaacttgtactctgaagcctgtgactcctcttaagcctcacatctcttcaccactactctggtgccctggttatctgtcccacagcgagaggtattttatgtccataaagtgcccgtggtaagtgctcagaattcatctcttggctgtggcgggtgctgtcatttctcattccattgaggggaagaaactgaggcacagtgagtccagaggagaatgggtcagggttgtgggaggaatgaatgggcctagctagtgacttgaaatggcaaccagtctctgcctgcttcctagccttccaagcccgggagtctccatccttcccatcctctgttctaactggccttgtcagatgcttttccccactgtactttcccctccctgctgccaggtactgttagattccaaaaataaaaggaaaaaataattatacactctgcttccttgttctcccctcttccaccctgagctttggggttaggagactaaaatgtcccccttccagaatccttcccaccttggtctgctggctctattccctagcccagagcagtgatttggattcaaatgccctgtaaccttcagcctccttactgctcctttcttgacctctcctaacgctttccagacccaggggactctggggtctctatactctctctaattgacctgaagatagaggctgggagcagggccattccagaggctctttggtctctctcttggctgagggaatttgggcataagcaggctgcaccctctggctaaataactcagcatcatgagggtggacctgagggtttaaagtagctctcattatatagatcctggatgttgagggttctctctcccacccccgcatccccagctcttaaaccctaacctcttactatttccatgacaactggcttcaattcaagccatttggctcagaaaaggttgagttagggtgatgatgggttagaaactaaacttcatgtgtccgccctcttgccctttactcccattcccaaccctggaggctttatacaagtgcttaagtgagtaggtgttggggagagcagggtttggggaataagggataaacggggcacagtgggcaggggccctcctattccagtaaagccaaataccaaaaaaatgaaaagtcacaataaataaataaataaaaattc

SEQ ID NO: 366539 - DNA, 1018 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtctgtcatctgataacaaacctatggttaacttggataagctgaaggaaagagctcaaagatttggtttgaatgtctcttcaatctccagaaaggtaatgtaggctcgatggaagtaatgtttttgtgacattagagcagcttatgggaactacataggctggaaatgaccctcctgagaatgtagctggctacaaagcatttcatttcacatacttgattgactgtcacctcctctcactgactcttgattatgttacaggaattatttcacaagctgattgttttttcccgtggattgttttcatagctttcacccaggctgctagagcgtggtctacatttcttttctttctttcttttttttcctttgggacaaggtcagcctgggtgacagagtgagactcgtctcaaaataataataataataataataataataataataataataatagtatgtgtgcatgaaatcagttcactttgaagaatacaatttttttcttttgaaacaaggcttctattttgatctaattgctcatgcttggagctgcctg

SEQ ID NO: 366540 - DNA, 676 bp, Homo sapiens
agctcctggaggcggaggccgcgggtgggggcctagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctaggtttgggatttcttcagttccaacaaaaggtaagagtacagagatacttctgagaaagttacctttttattctttcttttctggtataacaggttttatttctccaaaataaggtaaatttgctagctgtagaaactctttaagagattgtaacattcatctcctgctttaggtaaaattatacttaggccttcctgggcaattaagagagatactgaatgttatgagaggataggaagtgcca

SEQ ID NO: 366541 - DNA, 4998 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgtcgcccacaaaccctgctgtatgacatttgcaccacatggtgtgtgtccgtgccctttgacatgacagtgccaacaacatctcatgaaatttaaaataaatccccaaggcatcagaaacgtaaa

SEQ ID NO: 366542 - DNA, 3747 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggcgctggcctctctttccagtggctcttccggatcctgcagcttttgggtcatgctcctgtgctgctgtgcccctcagggtcctcctgcctcccgagcctccctgctccacatggcccctgcccagccctctccatccctcttgaaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatct

SEQ ID NO: 366543 - DNA, 5259 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccagagagacagtgctgcgaggtccccgcctcgtcctcacccccgctcctgaccccacaaagtcctggggtcacacctctacctgcgcggctctcgggggccacccctctcagccccatccggctcctgagcagctttgtccccagagggccccgggtcattcctctgaccaaccaggcacggcgcaccctgcatgcaagcctgggcgggtgctggggacggacgagtgacgcagcagacactgcctccctgaaggcatggcaaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgtcgcccacaaaccctgctgtatgacatttgcaccacatggtgtgtgtccgtgccctttgacatgacagtgccaacaacatctcatgaaatttaaaataaatccccaaggcatcagaaacgtaaa

SEQ ID NO: 366544 - DNA, 3675 bp, Homo sapiens
  misc_feature (62)..(62): n is a, c, g, or t
  misc_feature (3608)..(3608): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctaaaaaaanaaaataaattttgagggggggcccgtgtcccaaatcgtcctataatgagtcgttttacaattcactg

SEQ ID NO: 366545 - DNA, 2555 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatgggtaattgtatttgttatctaatggtgcatgaccaattacaacaaaacgtagtgggcttaaaacaacaaatatttgctg

SEQ ID NO: 366546 - DNA, 3146 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggtaaatcccagccactagtatgatggtaggctaagtcctgtgagtccctcaagtgcagtcaccaagcctagtgtgtgatggggatgcctgcataccagatcagtagagaaaaggacaaaaaccgtgtgatcactgaatagacacaaaacatttgacaacctccaacacgctttcatgataaaaacattcaacaaactaggaataaaaggagtttcttcagcctgatcaagagcatccgtgaaaacccccacaagcaggccaggcgcgggggttcacgcctgtaatcccacctcggtttccccaaatgctgggattacaggcgtgagccaccgcgcctggcccgggtgtcttttttcgaaaggataaattggcataggtgggatttcctcctcgatcttgagaaaatggccgagtgattagacaaataatagtaatgttttgcaatatcttgaagtgtaacctcttgtttccagttttggtgttttcttaaaaaggagcattcttcggaaagttaaaatgtcacgtcttaatttcagttttcctaatcagatttgataattcaagagtcttttcttatctagttcttaatctggctcactataccgttgaagacgctgaacccctagaactcttggtccagtacacccgccgtcgggtaccctctccgtca

SEQ ID NO: 366547 - DNA, 1942 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacgtcttgcgggggctgcccgtcttgcggggggccagttcgtccctttccagttttacagtgaattgctgcgtcttggggggctg

SEQ ID NO: 366548 - DNA, 333 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggtaattctgtggctccatcagctgccgacagagccgcctg

SEQ ID NO: 366549 - DNA, 5051 bp, Homo sapiens
  misc_feature (62)..(62): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggcgctggcctctctttccagtggctcttccggatcctgcagcttttgggtcatgaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgtcgcccacaaaccctgctgtatgacatttgcaccacatggtgtgtgtccgtgccctttgacatgacagtgccaacaacatctcatgaaatttaaaataaatccccaaggcatcagaaacgtaaa

SEQ ID NO: 366550 - DNA, 3765 bp, Homo sapiens
  misc_feature (62)..(62): n is a, c, g, or t
  misc_feature (3602)..(3602): n is a, c, g, or t
gtcgcgcgcgcggtcacggggctcgctcccgaggggcaggtcggggctgggagctggtgccngggtcggggtggcggcggcggcctgggccgcgaggtcgacgctcgctgctgcagcggcagaggctaaaggatccgccgcggcgctgtcgccggagagggagggccccgctgccgtcggtgaaaccagcccagagaagttacgggatttgcccccggggctcctgcccagcaagccagcgccgtgacccaggtgtgggggatgatggtgacgcttctcactcacatgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctgnaactgggggggggcccggtcccgaatttgcctataaggaggggtttacattgaatggccgtggtttacaaagccgtgacgggaaaaaacctgctgtccccaattaggcttgaagacatacccctttgccaggtgggctattcgggccggcgttgcccttttcc

SEQ ID NO: 366551 - DNA, 453 bp, Homo sapiens
cctggcgcagtgggacagcccaggtgcgtgtggagggtgctgggctgggtctgcctggtctcccaggacctgtgccccacacgctggctggaggctgcccgtggggtgttgtgtgttgtgcatggtggtctgacagccggggccataaactccccaggggcaggaggctccatctgcgggctccgagctcctgcagctggtcctctgggtagtggggactggctgtcggaggtagaaacccactcagctctctagaggaagaggatggtggccaggggtggcattggcagccacagagagtgcttggcatctgctgacgggccgtacggtggatcctggacactcttggtctacccccacgccacccacactgcttctagtctcacggggttctctctggccaccccaacatcatgtgaccttttagttcagcttgttaaaagtcagctgcca

SEQ ID NO: 366552 - DNA, 480 bp, Homo sapiens
tcttgcgcattcaccgaggctcactgtaccttggtgttcccatttctaaaataaggcctgtagtaatccctacctcactgagttgttgagagacttcatgtaaattgtttagcagggagcctggcacagaacaagagcctagcagaaaagtaagctgttgttactttaagcaaatatttagcagcctaaaatggtggctttacccagtttctgtaatggttgaagtgatgacagaattcagccaatcccaccccatagtttttcttgctaataaagcagtttgtttctaagtgtgttttgatgcgtataattaatacttcctgtccttgatttttggctgaaaaatgtcttctcttcctcgcaccctctgttattcccgtagtgaatattttcattgtggaagagaaattcccattggctcatggttggcattttatttctcctgtccagagacaatatttccacagcctcaaacgtgaa

SEQ ID NO: 366553 - DNA, 347 bp, Homo sapiens
tgcgccaggcatgtgagggcgtccggtggtgggtgcctggcctcgtcagctccaacgacaacccagcaccaccaagagacctgggagctgagtctcctaccagatggggagaccctgggacagagaaggaaggtccggatcaaactggagaagaatcgaagcagatgtttgcacctctttggtacctgatccaaacaaaccaattgtgacacaggttaagtttccaacttgagctagatatctgataatgatgagaaattattgttactcatgtcaggtgtgaccatggtagtgtggttttgtttttcttttttatgccagtatccttacctgaccgagagttgttc

SEQ ID NO: 366554 - DNA, 577 bp, Homo sapiens
tacattgagtaccaccgatgcttgtgtgatcagcgattagttcaacgaatatttattgagtgtaagaggcgctattctagtgggacacagcagtgaagaaaactgatgaaaatcttgcttcacagagtgtggacctgaaggccaccgagggaattatcggttttatgaagtcattctttcttgacctcctcagctacagggtttactcgttacctttgggacagctttatttagatcacttttataacttgttgaaaaagcatgacaataattagcacaaagtttaatcataaagaatttcagaactgcaaaggcagtgttaacacagctccagtgtgctgttacctttacctttagatgttgatgaaaactattgaatgaagatattaaaactgaaagtcttggttttcattaaacagggtccagtcagtggagtgaccaagtaaaaagtgaaaacaagtccccatgggatggcccatgcagtaagcctgcacttaggaaggctgaggcaggaggatgacttgagcccacaagttcaagaccagcctaggcaacatagcaagaccatttctttaaa

SEQ ID NO: 366555 - DNA, 1371 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 366556 - DNA, 1529 bp, Homo sapiens
aggtatatcatcctaagatcttcgtcagctctgacaaacatcctaggaacccactctaactcctcattttttcatgcctcctccagtgctcttcactcatgctgtttccccttcttctcttggcttcagactctggacattaatgtgaaggccccagccctgatgacaaaggcagtggtgccagaaatggagaaacgagggtacagagagtgagagagagcctgggtgagaggggacaccacacgggctgagggcactggtccacaatgggaagatggtcagctctcttctttttccagaggcggctcagtggtgatcgtgtcttccatagcagccttcagtccatctcctgtaagaacccttttgtctacctcttccatcccaccctccactccacatctttccacccctcctattacccaaggaagtttgtgtccccttgtagaatcacaccaccaagtccctgcccacaaaatagatgccttgcctccacaaaccacaacctaggggaggtttagccacaagacagttccctaactctgcccctcccttacaggagatccctattgagcactgccctctatgtctagttattagaaccaagaatgacctggaaactatgagtctaacacattctcttctttctccagggcttcagtccttacaatgtcagtaaaacagccttgctgggcctgaccaagaccctggccatagagctggccccaaggaacattagggtgaactgcctagcacctggacttatcaagactagcttcagcaggatggtgaggaaggggagctttgcatttgactgggaccccttgaaaggcatccatcttcttggacagggaagcccactacctgagtcctgagctctcagccactccattctccttccctggactttcccatattccctctctgtaccacctgccctatacaagccacactcttatcacaccttttctgaggtataggctggagactgaggtattcagactgtactcacactgtttcctccctccttacatggatgagaattggagagacgcagcaaaatgcatcactagaacctgaaacaaatgaaacagatgagggcagtggggagagctgggagctagaaaaaaataggaagtgaaagagggaagtctctctccccatccctcctctcagttaccatgaggatgggcagtttcttccctttccgttcttcactttcctcttcttaaacataaagagatttctgggtggggtggctcatgcctgtaatcccagcacattgggaggccgaggcgggcagatcacgaggtcaggaggtcgagaccatcttggctaacacggtgaaaccccgtctctactggaaatacaaaaaaattagccgggcgcagtggcgggcgcctgtagtcccagctactcgggaggctgaggcaggagaatggcataacccgggaggcggagtttgcagtgagccaagatagcgccactacagtccggcctgggcaaaagagcaagactccgtctctaaaaag

SEQ ID NO: 366557 - DNA, 802 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggtaaactgtcatgagggcaagggcactaagagacatgaagatgggaaggtctggtccctagcagcccacagcccgctgtctcagtcccacagataacacaggcaggctctcttctgcctcacagaccacgaattcataaacactatcactacagtgacctgagcaagaagtcagcttccctttcaaaaggtaaacacagagacatcg

SEQ ID NO: 366558 - DNA, 619 bp, Homo sapiens
tcctctttttccttgtccatccagagcttgtcccacacctgctcagtgacatccattatgcttccaaagaaaccctgcggataaaaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaattgacctg

SEQ ID NO: 366559 - DNA, 1138 bp, Homo sapiens
atataaagataaggtctcgctgcatggcccaggcttctctcaaactcctcagctcaagtgagcctcccaccttggcctcccaaagtgccatgattacaggcatgagccacagctccttgcccagaaggaagtttttatcaacatgggtaaatgcacctcccttacttactgcagccctggtccagaacttacccctctctctaggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 366560 - DNA, 1113 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 366561 - DNA, 1105 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 366562 - DNA, 989 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaagcccgctgtctcagtcccacagataacacaggcaggctctcttctgcctcacagaccacgaattcataaacactatcactacagtgacctgagcaagaagtcagcttccctttcaaaaggtaaacacagagacatcg

SEQ ID NO: 366563 - DNA, 982 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaattgacctg

SEQ ID NO: 366564 - DNA, 869 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaaggttatttatttatttttgtgatggagcctcactctgttacccaggctggagtgcagtggtgctatctcagctcactgcaacctccacctcccgggttcaagctattctgctgtctcatcctcctgagtagcttggattacaaacacatgccaccacgtctggctaatttttgtatttttagtacagacgaggtttgccatgttgcccaggctgttctcgaactcctgacctaaaagtgatccacccatcttggcctcccgaagtgcagggattgcaggcatgagccaccatgcccagccctgagtttgttttttttttttaatttacatt

SEQ ID NO: 366565 - DNA, 410 bp, Homo sapiens
attttgttgtcattgttgttgttgtttttaatataaagataaggtctcgctgcatggcccaggcttctctcaaactcctcagctcaagtgagcctcccaccttggcctcccaaagtgccatgattacaggcatgagccacagctccttgcccagaaggaagtttttatcaacatgggtaaatgcacctcccttacttactgcagccctggtccagaacttacccctctctctaggctgtgaagcttcatggaggtatcgatatcctagtctccaatgctgctgtcaaccctttctttggaagcataatggatgtcactgaggaggtgtgggacaaggtgagaggggattaaagcaggggggccggggggggcgccttggaacacattcagcacaaactccatctgctttt

SEQ ID NO: 366566 - DNA, 1126 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaattgacctg

SEQ ID NO: 366567 - DNA, 1685 bp, Homo sapiens
gcattcaacaaatatttattgaactaagatggcggctaagacctggggacagagtggttagggagaacttgagtgccccgagttctttgcatttccaccactgcttgagggactgtccagcctcctcgctaccacttagcccctgtaaaggaggaagtccctttgtcaacggacatgagaatgctgtttggccaatgaccatagtctgccctccagggcccgtgaagatggaagagaccttgggcagagtgaagggcagtgccaggcctggcgcagctactccctatcacgtctctctcccaggctcttccagcctcacctggtggactccatggcgaccacaggcctcacctccatgggcagtctcaaaacatttgccctcctgtgggctgtcacacacatagacccagactttcttggagaaggaattttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 366568 - DNA, 1560 bp, Homo sapiens
  misc_feature (1394)..(1397): n is a, c, g, or t
  misc_feature (1400)..(1400): n is a, c, g, or t
  misc_feature (1403)..(1403): n is a, c, g, or t
  misc_feature (1409)..(1410): n is a, c, g, or t
  misc_feature (1419)..(1419): n is a, c, g, or t
  misc_feature (1422)..(1422): n is a, c, g, or t
  misc_feature (1431)..(1431): n is a, c, g, or t
  misc_feature (1440)..(1440): n is a, c, g, or t
  misc_feature (1457)..(1457): n is a, c, g, or t
  misc_feature (1459)..(1459): n is a, c, g, or t
  misc_feature (1466)..(1466): n is a, c, g, or t
  misc_feature (1481)..(1481): n is a, c, g, or t
  misc_feature (1488)..(1488): n is a, c, g, or t
  misc_feature (1491)..(1491): n is a, c, g, or t
  misc_feature (1494)..(1494): n is a, c, g, or t
  misc_feature (1502)..(1502): n is a, c, g, or t
  misc_feature (1505)..(1505): n is a, c, g, or t
  misc_feature (1508)..(1508): n is a, c, g, or t
  misc_feature (1510)..(1510): n is a, c, g, or t
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaaaaaaaaaaaaaaaaaaaaaaaannnnttnggntttttnngaaaaaagnttntggcccaantttttcaanaggttgggggggggggntnacttganccaaggatttgaggnttgcggnaanttnttattaanaanttncnttcaagcttaggggggggggggaccttttttaaaataaaaacgggggacc

SEQ ID NO: 366569 - DNA, 1006 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaacccctgctcctgcgctggggtcccactggagtacgcgagactcgcaattacgtaa

SEQ ID NO: 366570 - DNA, 1024 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaattgacctg

SEQ ID NO: 366571 - DNA, 770 bp, Homo sapiens
agaccgctcacagcggtaccgagggcgggaagggggcaggcagggaagcggcccgcccttcgtcctgccccttcgccctactctgtcacctccgctggaaggagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggtgagctgcagggaaatgggcacagagccaggaggtggaaaacggagccagcctgagcctccttccctgctttcctagacagcagcacatttttactgtgtgcctttctattatgtccatatactaacgtcagagaatcatcccatctcagtcagagaattttaaaacattctaatgcttcaaccctgcatcatcccttgagtaccccaaagaaacagctggtactggttctgcagtaattttcaatctaattgaacagatgtgaagggtaaatacaatcacaaaatacatgttcccacccatgagttaataaacattcccctcttcttcagc

SEQ ID NO: 366572 - DNA, 756 bp, Homo sapiens
agtgttaagtgtgcagtctggcagccctctagagctctggccaattttgaaagcgtaatcaacaatgctaaatggaaaagaccatttatggcatggccaggcgtggtgactcatgcctgtaattgcagcactttgggaggccaaggcaggtggatcacctgaggtcaggaattcgagaccagcctgaccaacatggtgaaaccccgtctctactaaaaatacaaaattagccgggcatggtgtgcacctgtaatcccagttactcaggaggctgagacaggagaatcgcctgaacccgggaggcggaaggtgcggtgagctgagatcacgccattgcactccagcctgggcaacaagagcgaaactccgtctcaaaaaaaaaaaatggaaaagaccatttatggcctaaccttggtttttctgtctgtctcaacaagaagtcatatgactttaaaaaacagagcagtaaagtgttaaaaaaaaaaaaaaattagacttcaaggacctgtcaccatttggaagagattgactgactttttgctgtgtttggttaaatccattctgattctgattgtgcctgaggaattctaaatttatgaggtaaggtgtctttttcattgcttggagcaggaatttgtgggtcctcagtcctgtttcagttgagtgctgttcaaaactctggtcttctgccttgtatgggtataacaaaaatgtccccatatagcagaaaataatggtattctctttttacttaaa

SEQ ID NO: 366573 - DNA, 1188 bp, Homo sapiens
atgggtgcgtctgctgtggtctcgcgtattgtgattcggttgtggtggttgcgtgttgtgtgtagtgtgacgtgtgagtgacttcttgtttgcggtacgcctgtcgttcaggtgtcttcagtataaaattggtgtcgagcttcgcttctctactctggtggtcttgttgcgcgttctcttcagcctctttaaggtgtccccccgggcgtatgctgttcgtttctgtgcggtctgccttataggcgagagtaggggacagtgacccgggttgctgtctatggttggccccttccgccgggtggccctttccccctggcagcggcctccttgcctcccttccaccagtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaaaaagt

SEQ ID NO: 366574 - DNA, 1415 bp, Homo sapiens
agaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggaggaggaggaggaggaagaggagggctggtagggggaggtgtcatgagtgcgagagggtagacggacatgttccctactgaggtcactgctgccaactgtcctgctctgctgatctgtacagttccccccaccttctggacctaccctctcatggcccagagctcacttatctgagcctaaacctccccggtctcaagcaatagagagcagaaatgccagatgcagaggttctctggttaggatctttcaggatcctgctagatca

SEQ ID NO: 366575 - DNA, 141 bp, Homo sapiens
ttttttttttataacttagtaaaaaaaaaaaaatgtatgtggaattctgtctcttgaattctgtctcttggtaaagctcaaagccaggctagcctgaggtggcgcagggctctccttcctgtcccttcgatctccttgaga

SEQ ID NO: 366576 - DNA, 2873 bp, Homo sapiens
agaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccaccagtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaaaaagt

SEQ ID NO: 366577 - DNA, 1495 bp, Homo sapiens
  misc_feature (1478)..(1478): n is a, c, g, or t
agaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggtaccgtctnaggggtcgtctagtacc

SEQ ID NO: 366578 - DNA, 3577 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366579 - DNA, 3736 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggtaaaacacccacgacaagaagggggcggctaaaggaacccccgaggggccaaggaaacagggaccaggtcgggccaaggggctcaaggggggcgaaaaacgaagcacggcggggtacaccgcggcgggaacggaccgggattgggagccaccggggccagc

SEQ ID NO: 366580 - DNA, 3046 bp, Homo sapiens
tgtctggaattaggtttcccggcccatagtgtcctgggaccatctgctctggacacctttgggccatctctgcttgtgctatctagcatttatacagaaagaaacatctaacatctagagtaggttccttccatccctcctttcagcttatattcctcttccagcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366581 - DNA, 3941 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggtaaaaaaaaaaaaaaaaaaaaaaaaaaaaattttttggggggccttgggccttggaaaaagtttttataaaccaatttggttgggggggggggcccaggttgggttagggtgaagtgggcaataaggggtggtccccaagggagactccgggcgccattgagaacatagtggcttgggagttctctcaacccaattttaaaaaaaacgcgcgccggcggggaacacccggagcgcggtttcttggaaccaacattccacgagggggagtgtccggaagggcgacaatacacgggggatcttataacacaggggactgtccaaaggcgagcgctcagatcttcaaatttacgccgcgaccggtgggt

SEQ ID NO: 366582 - DNA, 3220 bp, Homo sapiens
  misc_feature (3155)..(3155): n is a, c, g, or t
  misc_feature (3158)..(3158): n is a, c, g, or t
  misc_feature (3160)..(3160): n is a, c, g, or t
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaaaccctttctctgganaanangcccccttacatgatagaccaggctaagagaccaatcctccctaacgcgctgctgtaacc

SEQ ID NO: 366583 - DNA, 2106 bp, Homo sapiens
  misc_feature (25)..(25): n is a, c, g, or t
tggtgatctagaggatcccgagagntgggacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366584 - DNA, 1882 bp, Homo sapiens
ccagccccttctgctcctgtctcctcgtctccgccttcctggagctccccctccctcttggcttctccgcacccgcccactgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366585 - DNA, 1804 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366586 - DNA, 167 bp, Homo sapiens
ggctcacgctgtcctgtggtcttgagatttttatttttgcatatgtaatccattctgtacaggtagctaactttgtaaacgctgtgtattccctctgcccccatggctgctggtgtaaataaactgcatctcccgttggtagccccggcctacctactctcattacc

SEQ ID NO: 366587 - DNA, 3160 bp, Homo sapiens
agacaggcctcctactggggaggaagagtaggaatttgaggatgctgctttgtcaaatcttttttccttccctgggttctcggctcccccttttcgttaccctttccccaaagctatggtatctcccattccagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366588 - DNA, 3652 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatgggttctctgtctgtacctctgcatcaaacacccttccccttcttttttcttcttcaggggaacttagcaattcggatccttttaagtataacaattcaactgggatcagctatgagaccctggggccggaggagcttcgcagcctgctaaccacgcttatattcctcttccagcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366589 - DNA, 3313 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggagagagtgcccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 366590 - DNA, 2552 bp, Homo sapiens
ccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggtaaaaaaaaaaaaaaaaaaaaaaaaaaaaattttttggggggccttgggccttggaaaaagtttttataaaccaatttggttgggggggggggcccaggttgggttagggtgaagtgggcaataaggggtggtccccaagggagactccgggcgccattgagaacatagtggcttgggagttctctcaacccaattttaaaaaaaacgcgcgccggcggggaacacccggagcgcggtttcttggaaccaacattccacgagggggagtgtccggaagggcgacaatacacgggggatcttataacacaggggactgtccaaaggcgagcgctcagatcttcaaatttacgccgcgaccggtgggt

SEQ ID NO: 366591 - DNA, 890 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaat

SEQ ID NO: 366592 - DNA, 2235 bp, Homo sapiens
gtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctgtaatcttgcccatagtatttacctcatttttgtgtctgttttgctgtgggtaagctttataagataaataatgtctatacatgtttcgactgtttaatgagtaatcaacaaaatctgccagagagtccctctggaaccgtataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggggaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatg

SEQ ID NO: 366593 - DNA, 1581 bp, Homo sapiens
agaagcagtgaagattctccctggtaacaacttaagtaaatcaagccaacaaatacgagtccaaataaacatttaatgagaaaatactgcctactttttaattttattgttaatatccttttgtattctgtaataattactgcatgtggagtgatttatccttcacctttggtgatctggtaacttagcagaatgcttgtctgcagaacaggtatgtgctaaatgctgaaaagccaaggacattcatctcactaaaaatgtctcccaacaagcaggctgctggggggtttgtagcgcttgtagggtggctgagttatttctttctgcaaacactcctgtcagcattatagagacttgcactatctgttaagtaaatgtgacttaggagaaggaacgacaccacccattcatggggtcatggctgcaagttactgccctactggttttctctttacctgataactctcaataattctaaagtttatcttagagaaaagtctttgagtcacctattttggaatttgagcccagtgaaatgataagcacctgcagtttgtatcacgtctctctctaaccaaatctctgagcattcttgtagcttgatagcaaattgggtgaactgctccattcactaaaagattgagttcagctttattgcaaacagaattatgaaggtctgttctcatgcatttactcagcctccttcatctgagtcacacaccactggaagtagcccctccttatattaagcaatattgacttgaaatggatcatttcctttttttaggtttactaaagaataccagagaaagaactgtatcttaatctatcttcctttccaatgaagtaaaaaacaaattatttgacctccaaatcctcagttaatgtaaattttgcatttgttgaaaacttggtatttcgcaggaaggacatcaggttttgtactgaacataacattgaacacgaagaacctttataagtcagtgttcactgggctgaaacttttactcctatctgaatatgttggcttttgagagctcttgggggattgatgttgttttttcaacttctatctcctacttaagtgatattaacagttgtgcttatgtaacatctgtgttgtgtgtgtatgtttttaatctctacttagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaat

SEQ ID NO: 366594 - DNA, 874 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagtgagtatttgtatagttactggctttttttctgtagtgttgagaatgatttttaaaactttgtcttgaatttaaatcagatttgcatttttggcttatcaaataaaaatgaaaggaattcctttatacaaggtgccttttgtaacaaccctgcacgttgtgcacatgtaccctaaaacttaaagtataataataataaaattaaaaaaaactttgtcttgaatttaaatcagatttgcattttcagcttatcagataaaaatgaaaggaattcctttcagttgcttccttttccttgaccttgatttttttcctatgcttctgcccttcttcagcagtgacttctccagccacactttaggttttgtcatcatcccctgggccccatattcctaccattccacctctagatctta

SEQ ID NO: 366595 - DNA, 761 bp, Homo sapiens
  misc_feature (9)..(9): n is a, c, g, or t
  misc_feature (13)..(13): n is a, c, g, or t
  misc_feature (25)..(25): n is a, c, g, or t
cctttgggnttcnttattttttctnaactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttacccta

SEQ ID NO: 366596 - DNA, 654 bp, Homo sapiens
aactctagaggtcccctgatgcatttagacctagtgatagagcatttcatgttaaaatgaattatttttgaccaagtgaggtacatttctattgatacaagtcatgcccctaaaagatagatgttatacagagtagcagtgaattaagaaatgtttcctctaaaagataaatataaaatttccaccatttgataccctaaacagtttaattttaattatagaatgttcatctacaaagtatctagaggaggcttttgctttattccatttctgccaaacttaagagaaaatgtactgatgaagggaaacatatccacattggaaaacatttgactgtctaaatgcaatcagattgcatttagacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgcaatcatacttcataaacagccccaccaagaaagaaaatcgcgatcccgatataaccatt

SEQ ID NO: 366597 - DNA, 1267 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaataaaaaaaaaaaaaaaaaaaaaaaaaaaaaaaaaaaaaaacaaaaaaaaaaaaaaaaaagaaaaaaaaaaaaaggggggggggggtaaaaaatttccccggggggggccaaagttaatgacgtgacacccggttttgtggtgtaaaaggggcgccaaaatagagggggagtaatataagagagagagcagacggggcggtgttataaacagttgttgtgtggtggagaaacttgtgtgtgggatattattgggaaaagacccccttcttgtggggtgaattgtggacacacctagagagaatttaagccaggaaattaacttagggtgtatggtggtaacgcgatattgtggaaaatttgtcagattgttgaaatagg

SEQ ID NO: 366598 - DNA, 1002 bp, Homo sapiens
  misc_feature (51)..(51): n is a, c, g, or t
  misc_feature (59)..(59): n is a, c, g, or t
  misc_feature (66)..(66): n is a, c, g, or t
gatgtgtatttgtcatagagtattattttgcgagagcgatggagagctcantagccacntcttcanactctattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366599 - DNA, 1006 bp, Homo sapiens
gagaagtaggaaggaaaggagagaggggaagaaaaaatttgaaaaaaaaataaaaactagtaaccacttttacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366600 - DNA, 1017 bp, Homo sapiens
gtagtagtgacaagtgttaaaagaagtgcggcaatgttttgtgtatatttattatccatttgtttcatcaaactttgggcccaaggattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366601 - DNA, 2652 bp, Homo sapiens
gtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctgtaatcttgcccatagtatttacctcatttttgtgtctgttttgctgtgggtaagctttataagataaataatgtctatacatgtttcgactgtttaatgagtaatcaacaaaatctgccagagagtccctctggaaccgtataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggggaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttacccta

SEQ ID NO: 366602 - DNA, 2992 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttataatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctgtaatcttgcccatagtatttacctcatttttgtgtctgttttgctgtgggtaagctttataagataaataatgtctatacatgtttcgactgtttaatgagtaatcaacaaaatctgccagagagtccctctggaaccgtataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggggaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttacccta

SEQ ID NO: 366603 - DNA, 1783 bp, Homo sapiens
agaagcagtgaagattctccctggtaacaacttaagtaaatcaagccaacaaatacgagtccaaataaacatttaatgagaaaatactgcctactttttaattttattgttaatatccttttgtattctgtaataattactgcatgtggagtgatttatccttcacctttggtgatctggtaacttagcagaatgcttgtctgcagaacaggtatgtgctaaatgctgaaaagccaaggacattcatctcactaaaaatgtctcccaacaagcaggctgctggggggtttgtagcgcttgtagggtggctgagttatttctttctgcaaacactcctgtcagcattatagagacttgcactatctgttaagtaaatgtgacttaggagaaggaacgacaccacccattcatggggtcatggctgcaagttactgccctactggttttctctttacctgataactctcaataattctaaagtttatcttagagaaaagtctttgagtcacctattttggaatttgagcccagtgaaatgataagcacctgcagtttgtatcacgtctctctctaaccaaatctctgagcattcttgtagcttgatagcaaattgggtgaactgctccattcactaaaagattgagttcagctttattgcaaacagaattatgaaggtctgttctcatgcatttactcagcctccttcatctgagtcacacaccactggaagtagcccctccttatattaagcaatattgacttgaaatggatcatttcctttttttaggtttactaaagaataccagagaaagaactgtatcttaatctatcttcctttccaatgaagtaaaaaacaaattatttgacctccaaatcctcagttaatgtaaattttgcatttgttgaaaacttggtatttcgcaggaaggacatcaggttttgtactgaacataacattgaacacgaagaacctttataagtcagtgttcactgggctgaaacttttactcctatctgaatatgttggcttttgagagctcttgggggattgatgttgttttttcaacttctatctcctacttaagtgatattaacagttgtgcttatgtaacatctgtgttgtgtgtgtatgtttttaatctctacttagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366604 - DNA, 690 bp, Homo sapiens
cactcctatatcctccactgcgcctgtagatgtgtgttcctccacgaataattattgttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366605 - DNA, 2598 bp, Homo sapiens
gtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaatggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctgtaatcttgcccatagtatttacctcatttttgtgtctgttttgctgtgggtaagctttataagataaataatgtctatacatgtttcgactgtttaatgagtaatcaacaaaatctgccagagagtccctctggaaccgtataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggggaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttacccta

SEQ ID NO: 366606 - DNA, 610 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttataataaggaagctgaggcacacagaggtagggaactaacccaacatcatacaaggaactgagatcaaggaactgagattcaaacacaaatgtctggctcaaacttacctgtaaactactctacatggagtgccataaaattctgcttaattaac

SEQ ID NO: 366607 - DNA, 328 bp, Homo sapiens
aatatttatttgttttttcttttttctaggatcttaattcatatcttgaagataaagtctaccttacagggtataactttacattagcagatatactattgtactatggacttcatcgctttatagtgagtatttgtatagttactggctttttttctgtagtgttgagaatgatttttaaaactttgtcttgaatttaaatcagatttgcatttttggcttatcaaataaaaatgaaaggaattcctttatacaaggtgccttttgtaacaaccctgcacgttgtgcacatgtaccctaaaacttaaagtataataataataaaatt

SEQ ID NO: 366608 - DNA, 1092 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366609 - DNA, 1175 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaaaaaacaccacgcagcaccgcccccccccgtaagctgaccaaacgggaactaccacaaaaggcctcggggcctaagggggaact

SEQ ID NO: 366610 - DNA, 1038 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggtttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366611 - DNA, 1113 bp, Homo sapiens
ggccaggtggacaaacattgcaaccatttaaattggaagagtgccacgttgcaccataaatggcagagagaacacctaaggagtcttggcccaatctaggggattcggggaaggcgtttctaaagccttggattatcagtttaagtgttacgacccacagtgaatgcgggaaacatcacaagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaa

SEQ ID NO: 366612 - DNA, 2830 bp, Homo sapiens
gtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctgtaatcttgcccatagtatttacctcatttttgtgtctgttttgctgtgggtaagctttataagataaataatgtctatacatgtttcgactgtttaatgagtaatcaacaaaatctgccagagagtccctctggaaccgtataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggggaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttaccctataagtttgtttattattccataaatacctaagggacttcctaaaccaaaatgaattgatgggctttttgagctttagacattaagatactcaattgtttccttgtaacattttaactattcaacatagcttctataagagttggtttatttaccttccttttgatattcgacatagct

SEQ ID NO: 366613 - DNA, 967 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttataatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagac

SEQ ID NO: 366614 - DNA, 992 bp, Homo sapiens
ggacttctgtttccaccaatgcgggaggttcttgttctgcaggtctggcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggttctcactctgtcacccaggctggaatgcaatggcgtaatcttggctcactgcaacctccgcctcctgggttcaagtgattctcgtgcctcagcctcccgagtaaatgggattacaggatcttaattcatatcttgaagataaagtctaccttacagggtataactttacattagcagatatactattgtactatggacttcatcgctttatagtgagtatttgtatagttactggctttttttctgtagtgttgagaatgatttttaaaactttgtcttgaatttaaatcagatttgcatttttggcttatcaaataaaaatgaaaggaattcctttatacaaggtgccttttgtaacaaccctgcacgttgtgcacatgtaccctaaaacttaaagtataataataataaaattaaaaaaaactttgtcttgaatttaaatcagatttgcattttcagcttatcagataaaaatgaaaggaattcctttcagttgcttccttttccttgaccttgatttttttcctatgcttctgcccttcttcagcagtgacttctccagccacactttaggttttgtcatcatcccctgggccccatattcctaccattccacctctagatctta

SEQ ID NO: 366615 - DNA, 504 bp, Homo sapiens
agtgtgtcacagtttgtttatttaactcaacagaaaattaaaggtagaattcttttagagagtcgcttagggaaacgcttataccatctccacctccagagatgttttctgtgctggaacatcggatataaaggttaagtttcaattaaaagtgcacatgtggatgatgaactagatagtaaaatgaacagatgaccccgttatccaggtctgttagcagtacgccagcagcggaatcctgtctttcagggcccaaccatgaatttctcattcatgcccttagcgcgatgtttttctcagttactttaagaaacatggacaagtgtgtaaaggtgtttaaaggactcatagtggtagatagcttattggtcagggtagatagagatatgttttctgtgtaactgtctagtttttgtcctaccattcggagactagggaattaacaggaagtgagtttacataggaccttgctatttgaaaatgaagttcatattttccactaaa

SEQ ID NO: 366616 - DNA, 500 bp, Homo sapiens
acagcttgctttccaataagccaaatgtaccagcttctttgtttttcaacggattggtgtgtccatttgatacaagaaaatggaaactgaacagccagaggaaaccttccctaacatcgaaatcaacagtgactctggtaaacatcctgcagaagacatgaaagaggaaaaagcatttaaagatctagaaacactgatgagatggttgaattaggcattctgcttcagagcagaatgctggggcagtgactggaaaaggaagcaagaatatgaagtttctccgtacagaccacaatgccaatgctttagtcccagacagcaggggccccgagcagcatgtcccaacagtttatgcctcactgcctgattagaaaaagagaaatgtattttattacctaccttttatataattaagtagtatctcctttagatggtggaaaaaatttttagaagattttgaataggtggcaaggataataacgtaagctttattaaatatt

SEQ ID NO: 366617 - DNA, 796 bp, Homo sapiens
aatgaagtgccatgttcgttctgaggcacgatttgtatgccatttggaggagggagtccgttcaagagaatggattccctgacaagctagtttgccagaatattccaagacatgttttagaagctacctatggcattaacatcataacgcctagagaggatgaagatccccaccgacctccaacatcggaagaactgttgacagcttatggatgtaagttgtgattcatcagaaaatgtgaacaaaagtaacagtatacctaatgaatagaaataagaatagtaatagtactagaattgctgttctgcaaagatacacatttataatatttcttcagcatttttcaagccatctttcgtctctgtgggccttgcctacaaagtaacctaaagtgcaaaaagcttttaggacgtttgctgctttgatggtacccacgtgcagcacaggggttctcatcgtaggctgtgttggctctttctggagtcgtctcccaaacaagaagaaagcggatgtgtggaagaaaatgaatccgcacgccacagcgaggcaggagagttaggaggggagcaccagaagggagacccctcagagacggggacagagtggagcttggttaggataggggcacaaagcatcctccttcctctcccatcagcccctgtaaacttatttgacattaagatgagtccacagctctcccacctctgtgttttatcccaattccacgtgggaacctatgatttcttgccttaaatgtaaactttaaaggtggcctggagaaccttgtgtctaccta

SEQ ID NO: 366618 - DNA, 428 bp, Homo sapiens
aggaacaagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaactcttgacctcagataatctgcctgcctcgacctcccaaaatgctgggattacaggcgtgagccaccacgcctggccttttaagtttctctgtaaattaatagtgagacatgaatcatttattgcaggtagccttaggttaggtgctgtggaggatagggcataaatagagatggctcctgccctttacgaagcatcagtctgttggggcacatgaggcatgtacttgaataactctagtacaagg

SEQ ID NO: 366619 - DNA, 1931 bp, Homo sapiens
aatgaagtgccatgttcgttctgaggcacgatttgtatgccatttggaggagggagtccgttcaagagaatggattccctgacaagctagtttgccagaatattccaagacatgttttagaagctacctatggcattaacatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaactgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaaaaaaaat

SEQ ID NO: 366620 - DNA, 2295 bp, Homo sapiens
aataaccagttgtgaggatttggctttatttcctcctcttctcaagaccacatcggtggagctcttggagctcagtggcaaccatatgggcttgccttcagttcaggaagaaagcagttcatgctattggtatggataagtcatgtattcgtttaccacttactgtggaggatgtaaagatgaggtaaaaatagtcacagccttcagatcatttatgatggaaagaggcagacttgcacccagtgagcaactgcaaccccacatacaggagtcgaggaactctcctgactttaacagtctaacccggcattaccgtaactgtccagttatgtcttgagttttgttttggaaaatattcaccataagtatgatcatgtccgtatactgaagaatacttgagtgggaatgcaaacgagaaaagaagaaagagatttcatcctagtctggggcgccatgggaagagctaggtctctagaacactttgaccattgatgtattagaaaaaggactcttcagctgcagtagaccaaaactcaactcagctaacttaaccagaaggcagaaagctccatcagagtgtgactgggtggagctgtctcctctgaggccacagatggcacttaggctgcactgttgtcattcatgttgtctttgtagggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaactgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaaaaaaaat

SEQ ID NO: 366621 - DNA, 1468 bp, Homo sapiens
ttttttttttgagacggagtctcgctctgtcgcccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaactgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaaaaaaaat

SEQ ID NO: 366622 - DNA, 1564 bp, Homo sapiens
aaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaactgagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactaatatcctttctgctttggaaacactctagttattacgtgcatattagggcttcaggtttattttgggcatttgagggattcagatttgatgaagaat

SEQ ID NO: 366623 - DNA, 448 bp, Homo sapiens
ctaatgtggttgaaacaggttaagttttgatattaagacaaatttccagaacacagctggtattaagtctagttgtagatggcatttgaaagtatgggactaaacaaagttgacgagggaatgaggagggggaagagatgaactgaagacagaatgctggggggagaaagaggaccagtgaaggggaggggggcggaagttcacccagtgactgactcctttttatcttgaagtgatccactaatagtactgtgcatatcccttaaaggatagcctgctgacagctcagataatgttttctcttatttcctaggagaatgtgagggctttgaccaaaggagtccaggctgtgatgggttacaagcccgggagtggtgtagtgactgcatccactgcgagctctgagaacggggcggggaagccctggaaaaaacatggcaacagaaat

SEQ ID NO: 366624 - DNA, 375 bp, Homo sapiens
gtatacccagctcaaacctcttgcttgtcttccagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactaatatcctttctgctttggaaacactctagttattacgtgcatattagggcttcaggtttattttgggcatttgagggattcagatttgatgaagaattgaaaatactagtgatctgcacaagtttatactgtgagatagcatgagaacttcagaatagaacctcatttcctgatttcagcagtgtagccttgaaga

SEQ ID NO: 366625 - DNA, 3309 bp, Homo sapiens
aaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaactgagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactagtttgccagaatattccaagacatgttttagaagctacctatggcattaacatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaactgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaaaaaaaat

SEQ ID NO: 366626 - DNA, 2710 bp, Homo sapiens
aaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaactgagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactagtttgccagaatattccaagacatgttttagaagctacctatggcattaacatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaactgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaattgttttcccagtcacaagcgtatgttcagtactgtacctagcgtacaacgcctatatgctttcatactacactcacagatc

SEQ ID NO: 366627 - DNA, 2174 bp, Homo sapiens
aaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaactgagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactagtttgccagaatattccaagacatgttttagaagctacctatggcattaacatcataacgcctagagaggatgaagatccccaccgacctccaacatcggaagaactgttgacagcttatggatgtaagttgtgattcatcagaaaatgtgaacaaaagtaacagtatacctaatgaatagaaataagaatagtaatagtactagaattgctgttctgcaaagatacacatttataatatttcttcagcatttttcaagccatctttcgtctctgtgggccttgcctacaaagtaacctaaagtgcaaaaagcttttaggacgtttgctgctttgatggtacccacgtgcagcacaggggttctcatcgtaggctgtgttggctctttctggagtcgtctcccaaacaagaagaaagcggatgtgtggaagaaaatgaatccgcacgccacagcgaggcaggagagttaggaggggagcaccagaagggagacccctcagagacggggacagagtggagcttggttaggataggggcacaaagcatcctccttcctctcccatcagcccctgtaaacttatttgacattaagatgagtccacagctctcccacctctgtgttttatcccaattccacgtgggaacctatgatttcttgccttaaatgtaaactttaaaggtggcctggagaaccttgtgtctaccta

SEQ ID NO: 366628 - DNA, 417 bp, Homo sapiens
cttttattaccatggagaagaaagcttcaatgaaatgcctgtttcagcccatcttcagtattggttggttaataccatttgttaacaccaatcctttcctcttttactgctaacatgtgactgtgtttaaaattatagattgcagcagagtgttggccaaggattattgtagtaggataaagtttccctgtatttgaaatttacccaaactgtagcaaatacatctttccttctttatggaggtcacacgtgtgcatagtatgtgcctgaatacaggtaaactttgtgttttaaaattacatggccttttttagagtcgactgaaggctagactcttcttgcccatgttgctggataggctttcaaatctcaggccttggagagttaaatgactttctgatatttcttacggtggag

SEQ ID NO: 366629 - DNA, 1635 bp, Homo sapiens
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaaaaaaaaaaaaagaggggggctaaagaatcctgaggggcagttagcgtaccgtttttgttcaagtgggccttaagggaggattaacagggcggcggcttcacgtgtggatgggaaggtctggattgtaagaacacttgggggatggggacccaagaatagcggaataaatagtatgtgcacatcgggggatgtggttttatacatataaaatacaacacaaatactaagaaagagtgataatcatatgcaagttat

SEQ ID NO: 366630 - DNA, 942 bp, Homo sapiens
  misc_feature (884)..(884): n is a, c, g, or t
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggncagagggggggggggcggggggggttccgccccaggagaagggacgggggcggggaaa

SEQ ID NO: 366631 - DNA, 867 bp, Homo sapiens
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaa

SEQ ID NO: 366632 - DNA, 308 bp, Homo sapiens
tcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaa

SEQ ID NO: 366633 - DNA, 1380 bp, Homo sapiens
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaa

SEQ ID NO: 366634 - DNA, 1039 bp, Homo sapiens
  misc_feature (886)..(886): n is a, c, g, or t
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaagagantcccttcttctttaccatgaattccaccctatcctggtcttatctcaatgatcccacatctagccttcaaaccctatcttctcccttagatttttccctttttttccccacgatacacatcttggattttccccctctcccattcccatttgg

SEQ ID NO: 366635 - DNA, 458 bp, Homo sapiens
tggtgacacaggagcagtggtgatgcctcatctggtgcattgcagaattggaggcccatccctgccagacctccaggctgagtttggcagcattagtgcagcgtcagcccctttcctgggcctggctccagagccagcaggaggcccgacgtgctgatggatcatcttctctcctaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctgga

SEQ ID NO: 366636 - DNA, 373 bp, Homo sapiens
atgggattagcactcttataaaagagactccagggagttagctagcacctgccatcttgtgaggacacagctggaggtgccatctgtgaaccagaaagtaggccctcaccaaataccaaatctgccagcacttagatcttaggcaacccagcctcaagaactatgaaaaataaattcctgttgtttaaaagctacctggtttatggtattttgttatagtagcctgaatgaactaagacaggacaccagtcattggatctagggcccattccactacagtgtgactgtatctaagctaattatatctgcaaagaccctatttccaaataaggataacattctgaggttgtgaatggacattaatatttgggag

SEQ ID NO: 366637 - DNA, 167 bp, Homo sapiens
  misc_feature (133)..(134): n is a, c, g, or t
atgggattagcactcttataaaagagactccagggagttagctagcacctgccatcttgtgaggacacagctggaggtgccatctgtgaaccagaaagtaggccctcaccaaataccaaatctgccagcactnnactgttgtttaaagctactggttatggtattat

SEQ ID NO: 366638 - DNA, 418 bp, Homo sapiens
ccccaaatatgagggtttctgaaagagctttaaaaaatgttgcctgccagtagcacatggattctcttttcagggtttgtatctacccagctgacacacccattcccccctcccttccccccagagcaagtgatttcttgttccaccctgcagcttactattggcaaggcatggcaggagtgaatctaggttccgtgtaccaccagggtaaattgccctctctattgcagtccttatggaaaggcactttttttcgggttcagcacgtccccatgcattcacaggtaccgaaagtgacatacacatacattgtaaacattgtgcccactgctctgcaaacgttcatttggcccttagcagttcacacatcacagccgattcatgtattcatgatgatgttcattctgttgttttctgg

SEQ ID NO: 366639 - DNA, 988 bp, Homo sapiens
gctcggtacccgagatacaccccactatagcagcctccgtggcctccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366640 - DNA, 688 bp, Homo sapiens
ggcggcggcgtccgggctttgtggccgcggcgcgcgcggcggggcctggccggccgggggcgcgccgccgccgccgccgccgagcgggttctggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaaaacacccggaacgcctcagccaaggcagaacgaaattcctgggagaagcaaa

SEQ ID NO: 366641 - DNA, 256 bp, Homo sapiens
ccaaatgctccttgctcctgtgtccaggtcccatctggagggtggtggagaaccttggtgctttgtcatttgggaagtgtgtccaaagttttctttcaagaaagaaaaagaagcctggaattgtcaatcatcctttctgggacttggtaggaaaaaggtggaaaatctgctatagagttatggccctcattacatcttgtgtatttgacataaggaatgtgtgtgtgtgatctttctatttctaacactgtgctgt

SEQ ID NO: 366642 - DNA, 1848 bp, Homo sapiens
ggcggcggcgtccgggctttgtggccgcggcgcgcgcggcggggcctggccggccgggggcgcgccgccgccgccgccgccgagcgggttctggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366643 - DNA, 1832 bp, Homo sapiens
gcactgcacctgtggggaaaggcaggagaagaaggagctgaggacttcaccccaccatctgcagaatacccaacaggctgttcagttctcagctaccaagggggcaccctttcctctcccagttggtgatgatttgttaacgtattgtggaagatcaagggctggactcaggcactcctgtcctgaaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366644 - DNA, 1245 bp, Homo sapiens
tttctctgcctgtaaaatctttgaacatatgttttctgctactgtttttcagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366645 - DNA, 1732 bp, Homo sapiens
gggggcgggggtggggggcgcgggccgggcgtagagggggccgggggccggcatggagggttttcgggccgagccgctgcgaccccggccttgcaggctgggcgccgggcggccgcctctgcgcgccgcgatgggactcgaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaactgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366646 - DNA, 440 bp, Homo sapiens
cctgtggggaaaggcaggagaagaaggagctgaggacttcaccccaccatctgcagaatacccaacaggctgttcagttctcagctaccaagggggcaccctttcctctcccagttggtgatgatttgttaacgtattgtggaagatcaagggctggactcaggcactcctgtcctgagtgagtaggaaagacgtctgggagaagggtggtttattttgtttttaaccaggcattgaagcagagagtaggtgggtacgtagcgatggtgaaggtagggaacatcatgcatacttggaagagcaattgctttggagagatagacagtttggggtttgaatcctagctctgccatttcttagctttgtacattttttgtgaggataaaataatgttttttcacatatctggcgtgcagttcaacaagcactagtaccgtatt

SEQ ID NO: 366647 - DNA, 506 bp, Homo sapiens
aaccttggtgctttgtcatttgggaagtgtgtccaaaggtaatctgttaatactagtaggtagggtactggtactctttctatacagtaaaacaactttgagttcatttcactcattttgcatttcagttttctttcaagaaagaaaaagaagcctggaattgtcaatcatcctttctgggacttggtaggaaaaaggtggaaaatctgctatagagttatggccctcattacatcttgtgtatttgacataaggaatgtgtgtgtgtgatctttctatttctaacactgtgctgtctaatacagttgtcacaagccacatgaggctcataggcacttgaaatgtgggtagaccacattaggatgtgctataattgtgcacaccacattttgaagacttagtacctaaaaatgtaaaaaaactcattaaataatttttatattgttacatgttgaaacaataatattttagatatgttggattaaaaaatatattaccaaaataaa

SEQ ID NO: 366648 - DNA, 1328 bp, Homo sapiens
ggcggcggcgtccgggctttgtggccgcggcgcgcgcggcggggcctggccggccgggggcgcgccgccgccgccgccgccgagcgggttctggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaag

SEQ ID NO: 366649 - DNA, 674 bp, Homo sapiens
gggggcgggggtggggggcgcgggccgggcgtagagggggccgggggccggcatggagggttttcgggccgagccgctgcgaccccggccttgcaggctgggcgccgggcggccgcctctgcgcgccgcgatgggactcggtgagtagggccggcctgctgcctacaaagccccggggcgcgggcctctggggtactcagtggcgcgcccacggctgggagcggggtgggctttggactcccgggctcggggagctgctcggggggaatccaggtgacctgcagtaccgcggtcttcccatcccggcgtccccactgtgtgctgatcactgtgctcggcgcttttccatacttgtctcctttaagacctccagtgccccgcccgtccagagtgtaacgggagggatccctcacttgcaggatgaaggccgagcatcacatccttgcttgactgaccttgggaaagctcctttactccgagccggggctactgtttctgtaaattagaggcgggggtcgggggggcgtggtataatatctaccctcaggtactattgtgaaagataatgtatgtaaatgataacagctaaattttgagcactctgtatgtaccaggccctaggtactaaacagttggcatgaattatcattgaatcatcaccctggcgctgtgag

SEQ ID NO: 366650 - DNA, 1786 bp, Homo sapiens
gggggcgggggtggggggcgcgggccgggcgtagagggggccgggggccggcatggagggttttcgggccgagccgctgcgaccccggccttgcaggctgggcgccgggcggccgcctctgcgcgccgcgatgggactcgaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366651 - DNA, 1917 bp, Homo sapiens
ggcggcggcgtccgggctttgtggccgcggcgcgcgcggcggggcctggccggccgggggcgcgccgccgccgccgccgccgagcgggttctggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagttttctttcaagaaagaaaaagaagcctggaattgtcaatcatcctttctgggacttggtaggaaaaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcaggaaggtgctttaaaaaagatgcatgaggaagaacaccatcaacaaatgtccatcttacaactgcaactgatacaaatgaatgaggtgcatgtggccaaaatccagcagatagagcgagagtgtgagatggcagaggaggaacacaggataaaaatggaagttctcaataaaaagaagatgtattgggaaagaaaactacaaacttttaccaaggaatggcctgtttcctcatttaaccggccctttcccaattcgccctaagactttgggggtggctctcttgtaattaatctgtgttggcaaagaatgtctggaacatggacttggcggtcagtaacctgtaacagagctacaactaggaaaattagagtggtagtagtcacttatttaagaattcattcaggtaaacagctgcaccctctgtaccccttaagtggcaaagaagctgttatagtcttctgaaaattatcactatgagtgctataattctgaatataatgtctcttaattagaattcatacaagaaccacgtgtgagtgttgttgttgttgtttttttttttaatcaaatgcaagtgtgactataaaggagtgtggctgattttttttttttcttttttctttttaaacagacagcagaacttttctatccaaatgaatgccgtcccatggaaagtggctgtcctgggaggctacacgtttctccaatggtgatgctgttgctcagaacttgctagaggtctttagggaacctccgtgagagctgcagcacctttttaattttctcggtgtcatcctctgagtatggattttctgtttttaaacagcccaaagtttagaagggtattttctaatgtggctcataaaccaccttttaaggcctttcctcaaacaggagttctaaataagtctccaacaatagtagttttgttggagctaaggatgtaactactttgagggagaaatgttcgtttagatttctacattctgttatgttggttttattaaaaaaaaaaaaaagacttgcaattttatagtcacactg

SEQ ID NO: 366652 - DNA, 421 bp, Homo sapiens
ctgcaacctccgcctcccaggttcaagcgattctcctgcctcaggctggactacaggcacgtgccaccacacctggctaatttctgtatttttttagtagagacggggtttcagtgagccgagatcacactactgcactcaagcctgggcaacagagtgagactctgtctcaaaaaacaaacaaacaaaaactgcacttcaatctaaaacttccttcctctctttctcttccacaggaatcagatctgcatcatggtctgaggttcctctcactctcgccttactttccctcacaggcattttccccaataaattatctcgtatgtttaatcccatcttcactgtatctcagtagatggaaactaacataccaggcttgagactttgctttacctccttttttccccctttcccatatttg

SEQ ID NO: 366653 - DNA, 330 bp, Homo sapiens
acacacacgcatgcatgcacacatacgcacactcctgacatgctctactgaaagctgcccagctacagagaggtgcgaatctaatccagggcacatggctgctttgcatttcactggctgtctagtgtcactctatgatataggcataaggtcatgactgtgagctatcattgtcacttatcttaatattaaaacccctctgatccaatctgtctgccttatctattacatcattcacatatctagattcttcaaacttaactactcattgcagcaaactcaggaatgccgagctctaaggcatctccatttacttcgttcatctcaatc

SEQ ID NO: 366654 - DNA, 721 bp, Homo sapiens
gttccctttgtctttgcaattaacagaaggacataccattgcgatggatctttaggatgcccatatttatagctgaacacactcactgggccctgctgtgtcccaaagggtagctctcttcttccttctcatggttttcctcttgctccttcaagctttggaaaaggctacattactgtagttcactggacttggttatgtaacaaaagtgagccaggtacctcaacaccattgatccttgtggacagccaaggtcacttttcatctttgaatggaggtcagcaggaaagacgagatggctgggctggcagagtctgctgcctgcccccccgctcacctccatcctgcactcctgtgctaacagccctccattgtggccactaaaacaccacatttctcagcctgctgtaagatgccaggagaagggtattgagacagtgcaataaagagtctgactacatttctgatgtctggctgcattcaaatctcattactccctcttctccttttgttccatatccaggaagctgaaaagaaggcccaggtgctccctcctttggaattggtgggaaatttaaaccccacaagcctctacccctgtgcaaaagccttcaccccagcctcatctctacccacaataaacgccaagccagtctctcttctctggattctaaagctatttttggatcattatgtaagcaataaacctttccatactttc

SEQ ID NO: 366655 - DNA, 287 bp, Homo sapiens
cagaaggtagagcttcccaactgactaaagactcaggtcctgcagggccgtgtagaacttgtggccatccctgagcaccctgccaccaggaagctgaaaagaaggcccaggtgctccctcctttggaattggtgggaaatttaaaccccacaagcctctacccctgtgcaaaagccttcaccccagcctcatctctacccacaataaacgccaagccagtctctcttctctggattctaaagctatttttggatcattatgtaagcaataaacctttccatactttc

SEQ ID NO: 366656 - DNA, 559 bp, Homo sapiens
gacctagtggttcatcagtcacttctctgcctgagtggtaggagcctagattttatagttgttttcaatgacaaaaatcatagtttataaaagagcataatctgacccagaggtgtcctttctgtcacgttatgattggggacaaagtagacatgctcttcagcttgatcatatagtagctaccagggtttagtacactgtctctataaagggcagatgataagtagttaaggcttatgagccatatggcttctgttgcaggcactcagctctgccattgtagtttgaaagcagccacaggctatacctaaagaaatgggcatgacagtgtgccaataaaactttatttacaagaacaggtgttgggccagatttggcccacaggccttatcttgccatccccttgatataaacatgactgaaaaatttatattctaatagaccataagacactgctctaaagtaaattgtatatttttaaatcatgtgtctgataaggagttaagatgcaaaatatataaggaactcctactattcaataacaacaacaacagcaaca

SEQ ID NO: 366657 - DNA, 476 bp, Homo sapiens
agagagaagctagactcgcctgtctctggtttttctcaccgcctgattgttcctttcagatgacccgcatctctcggagctgacctcagctcagcaagggtgcctgtgacccatggagcagtggccactatctctgcattgtgggagggtggtccgtgttgggtctgcagggtcgttgtcacagcgatgaatgtgtagatctgtgcttgctgaagctcaggctggtcgctgtcttgtcatcgtctcctgttacacagctttcaggctgcttttttggggaagttagactcgcctgctcttttttggggaagttccacctcactgcagccgggtatggtggtttgctcctgtagtcctagctacttgggaggctgaggcaggaggattgcttgagccaggagttcgaggctgcagtgagcagagatcacaccactgcactccagcttgggtgacagagtgagaccctgtctctaaaa

SEQ ID NO: 366658 - DNA, 388 bp, Homo sapiens
atcctaactcttatagtctgtttcccattctgtcactgagctgctgttagttcctttcacctgagtttattccatgtgaaaattgaagatattattcagacttcaacagagtgctccagaaatatttatcaactgctgtaaacttcactagaaatgctaaagaaatgttaaaaaaaatcttatcaatactttacaaagaaaataataccatcaacaaaaagtgtgcttacctattcacaaagatatagagccttactagcaaatataaaaataaaattgctgtttgtgactatgatcctaaagtgtaatgtgtttttttttttgttttttgagatggagtcttgctctgttccccggggttggagtgcagtggcataatctcggctca

SEQ ID NO: 366659 - DNA, 256 bp, Homo sapiens
gcctcggcagaagttaaatggatcttagagaatggctgtagactcccctaaacttaattattgggtgactccaaatgtagttgctgacccagatgtaatatctttatcaaaccacatggcccctggcatttggtatgtagctattgacttagttaatatctttttctgccaatttacaaggaccaccaaaaacaatttgtttttatctagcagagccaacaatatggcttcacagtcttgcctcagggctagatca

SEQ ID NO: 366660 - DNA, 377 bp, Homo sapiens
catgagccaccgcgcccagcctgcctctttttcctagcctgttgcattggcttgaatctagaataaagaacagtactaaagagagagaaggcatgcttgtcttgcaacagacattaaaaggaatgtgtcttagagcaacagtgcttcctagatgttatttggccctggaatgcttttttgatgcaatacccaggagcattctgtgttcctcaaacatactttggaaaatgctactagagcatttgactattaaggataaagtatctgagtgcggttgctcatgcctataatcctaccactttgggaggccgagggggatcacttaagctcaggcattcaagaccagcctagtaaacatggcgaaaccccatctctac

SEQ ID NO: 366661 - DNA, 719 bp, Homo sapiens
atgctcccttgcaaataattatgtctcccacccccagaggatttaaatgacttggggctcacgctgcttgtgataatagacaaaactccagcgttcccacaagattaataatgttcccttttcttcttttctatgcctttccatcgttacaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaaaagatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaat

SEQ ID NO: 366662 - DNA, 1178 bp, Homo sapiens
ctcgctgggccggcgcctcccgaccaagtctctacggtcgccctcccctcggggtggccacgagggactcctcctcctcttcctcctcccctccctccccctcggtctccgcctcctccttctcctcctccttcactgccccgacctcccgccccaggttccacgcgctctgatgcccgccccgctcacccagagaagccctgggccagacgtccacaacccaaggggttatggggaggcctctgctccctggacacagtagttctcaaactggacagtgtcaatcagcatcctccgggaggtctggggtggccccggaaatacatgtgtcccacctatcccagcaggtaatgatgaaactcctgctctggtccgggctaccggtgaacagcgcccagcgggccgggcccccaacctcgctcctgagcctgaacatccccccaaccccaccgtgagaattcagcgaagagtaaaagctggaaaaagttgcgtgtcttaggctaagcagaacaaagtggggtgacggctccccggctaggaacagagatgcccttagggagccctctgatggaagagctctccgcttaagaaggtcaccactcccttacactgagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaaaagatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaat

SEQ ID NO: 366663 - DNA, 914 bp, Homo sapiens
ctcgctgggccggcgcctcccgaccaagtctctacggtcgccctcccctcggggtggccacgagggactcctcctcctcttcctcctcccctccctccccctcggtctccgcctcctccttctcctcctccttcactgccccgacctcccgccccaggttccacgcgctctgatgcccgccccgctcacccagagaagccctgggccagacgtccacaacccaaggggttatggggaggcctctgctccctggacacagtagttctcaaactggacagtgtcaatcagcatcctccgggaggtctggggtggccccggaaatacatgtgtcccacctatcccagcaggagatgttgctgagatgggtgcattaaagtttaggctttccagagtttatattgctaacaacttgaaaggaaaaaagctaactagagaactgactggtcttatttgttttagattctgggctttactaagacttcctactctcagaatctctggactataaacgctgggtggggtgggagctgggaatgttattctggaaaattaatcacaaatgaaaagaaaatcaactctaagactccagttagaagatttttgaaaatggcagaacatgactggccttcattcaagtcagaatatttaaagcaatccttgctaagaagaacttgattttgtataagcagtcccttaaatacagttgcttctcaagaaaaccacacacaaaagatgtttgaatggctttatttacaaacatctcactccgtaagcctctgcaggtatttctagcctcccaggggccactgtcccgtttcacctgtaatttggatcacaattctgtttgttgtcacacacatcatatgaactgcttttcatgctgcttttatccacaaagctttacaagctttaat

SEQ ID NO: 366664 - DNA, 204 bp, Homo sapiens
aaaaaagatcattttttataaataatttataatttcgaattttggtaacaaacacataccttaaaatttaccatcataaccagttgtaagtatagagttttgtagagttaagaatatttacattgttgtgtagcagatttctagatttttttttatcttagaaaactctatacccattcaacaactattaatttccccttcctt

SEQ ID NO: 366665 - DNA, 353 bp, Homo sapiens
gggtaggatcctttaagaacagtctatcctcatagtaattttaaacacggcagctccttctcatttgatttgccctcctctacccaaattaaattgcctaattcatgagtaaacagctaataagagctcacggaagtcaatgagcccagcctcagaaaaacacaattttcaaattttggtagtcactgagtaaggctgcactaagtatagggtcccatttcaggtccaaagaaaaagagcatttcatccttctctgattgcatctgtccctgctgttgagcacctcacaaaccagggcaaacaatggctttgaggagatggggctgggccgacatccagaccccccaggacag

SEQ ID NO: 366666 - DNA, 220 bp, Homo sapiens
tagtccataaacagttagaactgatgcacacatccgtttctccttactcattttaaacagctatctgaaataggaagtgtaatataatctttaaagaatctgaaaacatgacagaaatgtttaaactataaacatatattgtatatgttagcatattgtatacattgcatattaacataagctagaatcattgacataaatttatataaacaaaaggtgt

SEQ ID NO: 366667 - DNA, 813 bp, Homo sapiens
gctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggaccctttgagagcatgatttctaccgaagcaaggggacatcccaagctaaattcaaaggactgagccttttcaaaattctaggaaaccgatgagtttttcttgcttaaccatagcgtttatacgtataagtgtattttctatctcaatttttttgagaaaaaatattaaattttga

SEQ ID NO: 366668 - DNA, 650 bp, Homo sapiens
ttaaaaagatttctttttttgagttgtaaaaattactcataaaaatcctaataaattttaaagagcaagatattccttattacatttataaagaatatcttgctctttaaaatttattaggatttttatgagtaatttttattaaaagatttctttttttgaaaaaaaaaaaaaaaaaaaaaaaaaaaaaaaaaaaagataggaaaaaaaaaaaataaaaaaaaaaaaaagaaggggggcggcggcggctttgaattgattttctcccgggggggggcgccctatacattagcggcacctaccagtttttttttggtaaaaagggggctccccaattaagtagggtgattcgtattttaataacggaaggaggcgggggggcggtatttaccaaaccgcggtgctgcggtgggagaaacaacgtctggtaggtgggcaacttttggtgagagaggcccccctactttcttgggggggggcgaaacatattgggggaacgaaacttcacgagagagaattattagagacctgaaggggaataataaaaccctcagagcgggtagctggtggcacaccagacgagattatcggggaggaaaaatgtgtacacgaggaatactgtaagaattttcagggggtgtgaaaggggt

SEQ ID NO: 366669 - DNA, 6211 bp, Homo sapiens
gctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagcagtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaatttttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttggatggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggctgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatcctgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcaatgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttgaacaaaaacaaaaaaaaacaaaaacaaaaaaaacaaaaacaaaaaaaacaaacaaaaaaaaaaca

SEQ ID NO: 366670 - DNA, 6157 bp, Homo sapiens
gctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagcagtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaatttttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttggatggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggctgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatcctgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcaatgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttgaacaaaaacaaaaaaaaacaaaaacaaaaaaaacaaaaacaaaaaaaacaaacaaaaaaaaaaca

SEQ ID NO: 366671 - DNA, 3764 bp, Homo sapiens
ctccaccattatcttttttttttttttgagacggagtcccgctgtgttgcccaggctggagtgcagtggcatgatcttggctcactgcaacctctgcctcctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttggatggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggctgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatcctgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcaatgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttgaacaaaaacaaaaaaaaacaaaaacaaaaaaaacaaaaacaaaaaaaacaaacaaaaaaaaaaca

SEQ ID NO: 366672 - DNA, 388 bp, Homo sapiens
cccatactatatactgaattctcttatgtggcagggctcttaaacccaaagctcaaagtgctttctgcagaatactgtgaaatcctgacatattacaatggctgcgttaggaactttgatcctgtggaaaatattatcttctgctagagtctaatgtagataattaaaggcagtctgtctgcagaggtttaaggaatgagttaggagaaaaaattaatgttaattccgtttaaatgaaactaccagcagctgctggagaggtagagatctgtcagtgagctttcttttcaccactgaatgtgctgcttgggtttgcaggcgggaagcctgcaatgaaggagaaggagaccctccactctatgtcaacgtgaacatgttcagtgggcag

SEQ ID NO: 366673 - DNA, 147 bp, Homo sapiens
agcctgatgacctgtgtcctctccttaggtgctgataggagatgtggaagatgccatctgccttcatgccttctactatgccatatggaaacgatatggtgccctccctgagagatataactggcagctgcaggcccctgacgttct

SEQ ID NO: 366674 - DNA, 805 bp, Homo sapiens
  misc_feature (439)..(440): n is a, c, g, or t
  misc_feature (468)..(468): n is a, c, g, or t
  misc_feature (496)..(496): n is a, c, g, or t
  misc_feature (526)..(526): n is a, c, g, or t
  misc_feature (531)..(531): n is a, c, g, or t
  misc_feature (548)..(548): n is a, c, g, or t
  misc_feature (550)..(550): n is a, c, g, or t
  misc_feature (566)..(566): n is a, c, g, or t
  misc_feature (640)..(644): n is a, c, g, or t
  misc_feature (664)..(664): n is a, c, g, or t
  misc_feature (667)..(667): n is a, c, g, or t
  misc_feature (672)..(672): n is a, c, g, or t
  misc_feature (687)..(687): n is a, c, g, or t
  misc_feature (705)..(705): n is a, c, g, or t
  misc_feature (717)..(717): n is a, c, g, or t
  misc_feature (780)..(780): n is a, c, g, or t
gctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcgcgcgagcgcgaacgtttnntacgtttcgttttcgttcgcgttttcgntcgttcgcgcgtttacgtatttacgtantaatcgtcgtacgatcgttcgtcgcgttcncgtcngtcgatcgttcgtttcncngattattcgtcgtacngttttcgacgtttttcgatttttcgttcgttttttcgtacgtacgaacgtacgatttcgtcgacgtcgcgttcnnnnngatttacgtatcgtcgaacncgngatcngacgttccgtcgttngcgttttttcgcgttacngtcgtttttacncgttcgaaaatcgtttaacgatcgaatttattttacgtattttaacgtacgtcgattttactngttttttttattcgattttttatac

SEQ ID NO: 366675 - DNA, 5675 bp, Homo sapiens
ataaataagagttgctggcaattatagtttctgatgggtgtttacttttattgtcttctcttttgaaataaagtctttttgttgaattttaattttctttttcagttcaaatctgaacatcaatgatgtactagggaactactcattgactcttgttgatgcattggatacacttgcaataatgggaaattcatccgagttccagaaagcagtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaatttttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttggatggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggctgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatcctgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcaatgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttgaacaaaaacaaaaaaaaacaaaaacaaaaaaaacaaaaacaaaaaaaacaaacaaaaaaaaaaca

SEQ ID NO: 366676 - DNA, 2156 bp, Homo sapiens
gctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagcagtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctggtatgtgtgttgcaagatgaacccaggaatatttagtattgcttagagcaagcattcgcatagtcttccatctgacaggtacttactggctaaagctatgtgctggacattgtgcattcccaggatgcaaacgctgtcagaaccaaaggatattactatcttctttcatggtttccaaccttgttgaaaagtcatttgtcaagtaaaccaagaactgaacttatgattacaaactgcggcagatcttgcccagtacagacacagtaacagcgacggttacgtgtaccagattacatgcgttcaggtaaaactctagatgagcacgaggaccatagtctgatcga

SEQ ID NO: 366677 - DNA, 5484 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366678 - DNA, 3432 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtc

SEQ ID NO: 366679 - DNA, 1343 bp, Homo sapiens
ctcatgaatttgcaaatttattgactgaggcactggggttgggaggtagttgtacagaaaccaaagaggctaaacagcagaactagatgcagccggagagctcaatggcttcttccaggtaggttaagacatgaaggatttgcaaacctcgggtagcactatgagagctctaagcccatcggtgcccctggaaaacacctccaactccttcgcctccgtggtaccctgggggatctatttggacggccaggtaggcgcctgcttctgctgggtctggtggcagatcgggacgcccttgccactcccggagccacccacggaggagccgccgccgccgcctccagaggaaccacctccgcagacggagcccccgccactgatgatgcagccgctgccaatcccggaggagccgccgccgcagccggagctcccgccgcccccgccgctggagaagcagccgcttccgccgctgccgccgccgccggacgacccccctccgtaactcggctggggcgcgcacgaggtctgagtgacctgctgcgaggagacgtagccggagccgctgccgccagaggagcctccgccgcagccagagccgccgccagagccgccgccagagtagccgcagacagagccgccgcccccgccgctggagaagcagccggagccgcccccggaggagccgccgctagagacgcctccgtagctctggcactggaccgcctggcccgagaagccgccgccgccggaggagggaatccggaatccgggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366680 - DNA, 1877 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (1692)..(1693): n is a, c, g, or t
  misc_feature (1695)..(1696): n is a, c, g, or t
  misc_feature (1718)..(1718): n is a, c, g, or t
  misc_feature (1724)..(1724): n is a, c, g, or t
  misc_feature (1726)..(1726): n is a, c, g, or t
  misc_feature (1728)..(1728): n is a, c, g, or t
  misc_feature (1731)..(1731): n is a, c, g, or t
  misc_feature (1741)..(1741): n is a, c, g, or t
  misc_feature (1743)..(1743): n is a, c, g, or t
  misc_feature (1750)..(1750): n is a, c, g, or t
  misc_feature (1753)..(1754): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgtcnncnnttcggtaccggtacagtccaanatagcngntncgnagaggggatngnggtacgngannggccccggtaaattaggccggaccgaggggaagcgcacatcccccccggggcgggaaaccagagagaaacgttgccacgcggaaagaggcgggggaccaccccctagaagcggaggagggata

SEQ ID NO: 366681 - DNA, 1052 bp, Homo sapiens
  misc_feature (23)..(23): n is a, c, g, or t
gatcgagctcgttaccggactgnagatgtctgagattatcatacctgctgagggtgaaggggagtgagcagacactcgggagggtgtcttgaggctcagggagttatcagttatagaatgttgttgagttggaggaggtggctggtggcccatcctgttttttaaagtttcagctgtgaggtagggccagtagggcaatcctgaagaatgacgatgctccgttgccggcattctgacccagttgcaaagagcctttcttgcagaaggggggattttgcatttgtggtagtcctctgctcgccgccgtaactcttgcgcacgttgaaacattttctgtattctggcggtcttcctctttccattgattttgtcatgatggttgattttcgttgtcaccttcctcttacggattttagctctaacttttgtttccacatgggactggagatgtctgagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcagacatctccagtccgggatctctatatcgaggt

SEQ ID NO: 366682 - DNA, 355 bp, Homo sapiens
ccgaaaaagtttaactacattcatgttcttgttctgttccatcaccttcccctactttccattttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366683 - DNA, 430 bp, Homo sapiens
tcagtcggtacctcgcgaacgtgtatcccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataacacgttcgcgaggaccgactcgatg

SEQ ID NO: 366684 - DNA, 1652 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgctgccggagggcgttgcacaattgcttcggcccaaggcaaccccccagtggacgcccttctttgcaaacttcccgaacattcggtgattcccggggcccaaggttgtgtgggggcggacaagaaaacgcgcgtttaacaaggcgcacggcgcccttttccgggacaacggcttgggttcttaccacccattcaaagccaggagtgaaccgaatttgtacgcgggagggtttccacccaaagattgccccccaatggtttgcaggtaccttccaattacgggaaggctttccagaagaagtcctcgtggtgggccttttaagcgtggggtgtcaaccaaagtaccaagtaccgtgctggacagggtcggggtctatgatgggcaagattgccccgggggttggtgca

SEQ ID NO: 366685 - DNA, 5865 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaaaaaaaaaaaaaaaaaaaaaaaaaaaaaaaaaaaaaaaaaaaaaaaaaaaaaaaaaaaaaaaaaaaaaaaaacacaaaaaacaacaaaaaaaaaaaaaaaaagcagggcggcgccggcaccaccaaagagaaacacacacaacacaccggggtgggcaggagccaacgaggtgaaacacacaaggaacaaggagcacccaaaaagcgacgcgcaacaacaaacatggggggtaggcaacaccacgcagaacacaacacccgcggcgggcaacacggtgcttaaaaaaaaccaccaccgagaggggcccagcagaagacacaacggggcacaccaaacgcgcggtggccaacgagcccgcgcgaaataacaaaaagccgggg

SEQ ID NO: 366686 - DNA, 5412 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366687 - DNA, 5834 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaaaaaaaaaaaaaaaaaaaaaaaaaaaaatttgtggggggcttgggcccttggaaaaaggtttttaaaacatgggtggggggcgcgcgggggccccaagttgggttaagggcacaggtggggccaaaagacgcgggctccctagaggagaaaccgcggcgccaggacataggggcggggagatcctctccccgagattaaaagagcgcgccggggggggaacaccgagaggcgtttctgggagacaaatctccagaggggggataccagagaggggccataacggggggggcgtcatatcaaaccggggggggctccagggggagagcctcagatgtctcagaattaggcg

SEQ ID NO: 366688 - DNA, 5934 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (5658)..(5658): n is a, c, g, or t
  misc_feature (5662)..(5662): n is a, c, g, or t
  misc_feature (5737)..(5737): n is a, c, g, or t
  misc_feature (5741)..(5742): n is a, c, g, or t
  misc_feature (5748)..(5748): n is a, c, g, or t
  misc_feature (5763)..(5763): n is a, c, g, or t
  misc_feature (5771)..(5772): n is a, c, g, or t
  misc_feature (5779)..(5779): n is a, c, g, or t
  misc_feature (5807)..(5807): n is a, c, g, or t
  misc_feature (5816)..(5816): n is a, c, g, or t
  misc_feature (5820)..(5820): n is a, c, g, or t
  misc_feature (5833)..(5833): n is a, c, g, or t
  misc_feature (5843)..(5843): n is a, c, g, or t
  misc_feature (5856)..(5856): n is a, c, g, or t
  misc_feature (5869)..(5869): n is a, c, g, or t
  misc_feature (5890)..(5892): n is a, c, g, or t
  misc_feature (5900)..(5900): n is a, c, g, or t
  misc_feature (5903)..(5904): n is a, c, g, or t
  misc_feature (5914)..(5914): n is a, c, g, or t
  misc_feature (5920)..(5920): n is a, c, g, or t
  misc_feature (5925)..(5926): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacagagcacagaattaaaagccaaagcctcggaaaggagacaaagtaaaggctcactatggaggattcactgtacagaatgaagccaacaaataccagatctcagtgaacaaatacagaggaacagccggtaatgccctcatggatggagcatctcagctgatgggagacaatgacngctngttaacatcagatcccagaagacagcgttctaaagaagaccgtggtggatggtggtattatagatgtcatgcagnccanncaaacngcagatactacttgngtggacannacacctnggacatggaaagcatggcacaaatgatngtgagtatngatnaattggaaggggncatggtcctnaatgaggaagatnagtttgaagatcnggcccttttttccacagaatnnnccccaatncgnnaattttgctntctgtntggannacattttt

SEQ ID NO: 366689 - DNA, 5526 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcagtgtgcttcccggaagcacactgcaacaaacgagggtgcataagctggttttaatatgtacctgggagtgttaagcttagaggaaatcacagtctgcaatccggcc

SEQ ID NO: 366690 - DNA, 5427 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366691 - DNA, 3265 bp, Homo sapiens
agagaaatctaaatttgagaaaattagagaatgtaataaactgatgtcgtgatggattgatcatggacagagatgttaaggaaactcttagatgtagaaatggcataacaggatcactatggttcatcatgtaagtatttcatgggatgaggaatggtgaaaaccaaaacagattgttgagagatttggttgggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366692 - DNA, 4958 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (4910)..(4910): n is a, c, g, or t
  misc_feature (4914)..(4914): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctanggcnaactgtgtacccagaccggggataagatcgttagatcaccacaa

SEQ ID NO: 366693 - DNA, 4177 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcgaacctatgaggcgggcagcctcacgctggccggacagcaggcaccgtgggtggtggaatagtacttgcgtcctagcgacctatga

SEQ ID NO: 366694 - DNA, 2031 bp, Homo sapiens
gcggccgactactactactgctcgaattcaagcttctaacgatgtacggggacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366695 - DNA, 3478 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttggaaaaaaacctttaataaaatttttcttttaaaaaaaatttttttaaggttttggggccaaaggggaatccctgaaggagggtattattttttttttaacagaggg

SEQ ID NO: 366696 - DNA, 3013 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaa

SEQ ID NO: 366697 - DNA, 3289 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgggctactgggtatagccaaattggcgataaagtggtatcaggggctggccagagggaaccgcaacgtccggcgactggctgggggaccctccgggtgggaacctggtcctcccacaccccggtagagacccccaaaccccccgcagggccgccgccaccttacaccagcgaccggcacctccc

SEQ ID NO: 366698 - DNA, 1754 bp, Homo sapiens
  misc_feature (23)..(23): n is a, c, g, or t
gatcgagctcgttaccggactgnagatgtctgagattatcatacctgctgagggtgaaggggagtgagcagacactcgggagggtgtcttgaggctcagggagttatcagttatagaatgttgttgagttggaggaggtggctggtggcccatcctgttttttaaagtttcagctgtgaggtagggccagtagggcaatcctgaagaatgacgatgctccgttgccggcattctgacccagttgcaaagagcctttcttgcagaaggggggattttgcatttgtggtagtcctctgctcgccgccgtaactcttgcgcacgttgaaacattttctgtattctggcggtcttcctctttccattgattttgtcatgatggttgattttcgttgtcaccttcctcttacggattttagctctaacttttgtttccacatgggactggagatgtctgagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366699 - DNA, 3394 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaaaaaaaaaaaaaaaaaaaaaaaaaaaaaaaaaaaaaaaaaaaaaaaaaaaaaaaaaaaaaaaaaaaaaaaaaacacaaaaaacaacaaaaaaaaaaaaaaaaagcagggcggcgccggcaccaccaaagagaaacacacacaacacaccggggtgggcaggagccaacgaggtgaaacacacaaggaacaaggagcacccaaaaagcgacgcgcaacaacaaacatggggggtaggcaacaccacgcagaacacaacacccgcggcgggcaacacggtgcttaaaaaaaaccaccaccgagaggggcccagcagaagacacaacggggcacaccaaacgcgcggtggccaacgagcccgcgcgaaataacaaaaagccgggg

SEQ ID NO: 366700 - DNA, 1317 bp, Homo sapiens
  misc_feature (9)..(9): n is a, c, g, or t
  misc_feature (42)..(42): n is a, c, g, or t
  misc_feature (52)..(52): n is a, c, g, or t
  misc_feature (76)..(76): n is a, c, g, or t
  misc_feature (79)..(79): n is a, c, g, or t
  misc_feature (81)..(81): n is a, c, g, or t
ggccccccnccccccccccccgcgacaacaaaaacacttacnggcaataacnatacactcaaggagtggtcgtgantananggaagaagcctgcggtcgccctcacacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366701 - DNA, 2604 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggttcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacataatatcaagatattgcagtgattggggagcaggtactattccggatgtgtgtgcccccaggggat

SEQ ID NO: 366702 - DNA, 1848 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagaccccttttccagagctgtgatactcaggaatcag

SEQ ID NO: 366703 - DNA, 1848 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (1830)..(1830): n is a, c, g, or t
  misc_feature (1832)..(1832): n is a, c, g, or t
  misc_feature (1834)..(1834): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagaccccttttccagagcntnangatcctctagatca

SEQ ID NO: 366704 - DNA, 469 bp, Homo sapiens
gttttatatacggtattagagagggcgaatgctggagtattgctaatgggctatggagaccataatccatcataagtaatagctaagggtgactggtaggaagtttgtttctcataggaggtcgttatgacgttgcgtcgatagcggaatcgggaggtatgcctgcttcgaatgtcatagtgacacacttcgacaatctggactaccccaagatggcacccaagtgtttggcttctggctacctaaggttaacatgtcactagagtatttttatgagagacaaacattataaaaatctgatggcaaaagcaaaaactattctccagagttctccccttcctctccggacgcgtgggatttatgaattttatattccgtgaatgtatattgtcttgtaatgttgcataatgttcactttttatagtgtgtcctttattctaaacagtaaagtggttttatttctatcaca

SEQ ID NO: 366705 - DNA, 290 bp, Homo sapiens
ccccagggtctgaatccaggctcggtagcctcaggcctgggcataccatggcagagtccatcaactgctgcctgttatctaattgcagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgc

SEQ ID NO: 366706 - DNA, 2130 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttagga

SEQ ID NO: 366707 - DNA, 5819 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaaaaaaaaaaaaaaaaaaaaaaaaaaaaaaacccggaaaaattttcccccgggcgaaaaaacccagagagcccccaagattttgttcgggggttaccccggtgtaataaaacacccgagaaaaccgtggtttccgggaggtacatgctgtgtgacggagagtgaggtccgctgtggtttttgccccccgttttcgttgtgcaggcttttgagctgccccggtagggaaaatccccaggaagggcgcgtggggtgccccacgtggggttcttaaaaaagcgcggttttatctccatacatttgaaggggggcacttgtgtagcggggagaattttcc

SEQ ID NO: 366708 - DNA, 5934 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (5676)..(5676): n is a, c, g, or t
  misc_feature (5712)..(5712): n is a, c, g, or t
  misc_feature (5716)..(5716): n is a, c, g, or t
  misc_feature (5737)..(5737): n is a, c, g, or t
  misc_feature (5741)..(5742): n is a, c, g, or t
  misc_feature (5748)..(5748): n is a, c, g, or t
  misc_feature (5763)..(5763): n is a, c, g, or t
  misc_feature (5771)..(5772): n is a, c, g, or t
  misc_feature (5779)..(5779): n is a, c, g, or t
  misc_feature (5807)..(5807): n is a, c, g, or t
  misc_feature (5816)..(5816): n is a, c, g, or t
  misc_feature (5820)..(5820): n is a, c, g, or t
  misc_feature (5833)..(5833): n is a, c, g, or t
  misc_feature (5843)..(5843): n is a, c, g, or t
  misc_feature (5856)..(5856): n is a, c, g, or t
  misc_feature (5869)..(5869): n is a, c, g, or t
  misc_feature (5890)..(5892): n is a, c, g, or t
  misc_feature (5900)..(5900): n is a, c, g, or t
  misc_feature (5903)..(5904): n is a, c, g, or t
  misc_feature (5914)..(5914): n is a, c, g, or t
  misc_feature (5920)..(5920): n is a, c, g, or t
  misc_feature (5925)..(5926): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcacaaaaaaaaaaaaaaaaaaaaaaaaactcggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacngcatgttcttcagcacgtatgacagagacaatgacngctngttaacatcagatcccagagnccanncaaacngcagatactacttgngtggacannacacctnggacatggaaagcatggcacaaatgatngtgagtatngatnaattggaaggggncatggtcctnaatgaggaagatnagtttgaagatcnggcccttttttccacagaatnnnccccaatncgnnaattttgctntctgtntggannacattttt

SEQ ID NO: 366709 - DNA, 5237 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366710 - DNA, 5423 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttgtttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366711 - DNA, 5484 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (3407)..(3407): n is a, c, g, or t
  misc_feature (3413)..(3413): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttggaattaaaactttaatataaatcctcctataaaanaaaatnatttacacgttgaagggtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366712 - DNA, 5459 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcaca

SEQ ID NO: 366713 - DNA, 5519 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgcgtccgtcgaagtcattcggctactttgggaaagttggtatgaagcttaccacttaaagaggaaccgagcttctgcccactgtcaccgtgacaattcgtggactctggtcagtgcacgaac

SEQ ID NO: 366714 - DNA, 5160 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
  misc_feature (5141)..(5141): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcactgggaagtaggggaaggtgatgtgacaacctttcgctttggnggtagaggcgtcctaggtt

SEQ ID NO: 366715 - DNA, 4782 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcagacatctccagtccgggatctctatatcgaggt

SEQ ID NO: 366716 - DNA, 4153 bp, Homo sapiens
  misc_feature (7)..(7): n is a, c, g, or t
  misc_feature (316)..(317): n is a, c, g, or t
  misc_feature (348)..(348): n is a, c, g, or t
  misc_feature (657)..(657): n is a, c, g, or t
tctgtgncttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctnnaaacagcagatggcttccatatccagagagnaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgngccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccatacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcacaaatactctctcttgtctgctgccaagctgcgtgtgaggggatcctcatagagtcggcca

SEQ ID NO: 366717 - DNA, 146 bp, Homo sapiens
atatcagcattcctgagtatgactggcctatcattttctggttttgtactaagtctttggttttggtattcagatcatagagttatcatagcatgaatcagaaattagcccatttttccattttatgaaaatatttcaataagatt

SEQ ID NO: 366718 - DNA, 626 bp, Homo sapiens
actatttaatcttatttcacttaggaccttggttatttatattagttgtctataggcagtggaacataattaaataccattttctagttaaattcacctaagacaacttttaaacaaaactcttgcgttaaatgttgccattaatgaagcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttgtaagtagaaattacctcttattttaaatactacttcgtatgaaataagatagcatgtgcagaatttactgacagtgtgctatttaagtccagttaagacctcagtcagagatggactaatataaatagtatgtaggtttaggtataatgaactgagagtctacactgtagaagtttactcttgctagtacaacattgatttgttaaatgtgaagtttgaatgtggccattttccctcccccatacttcatgtcctcacattagagagaggatgatttaagtgaatcaaaccca

SEQ ID NO: 366719 - DNA, 526 bp, Homo sapiens
ttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttctgggtttgaatgtacgcctttagttcttcaaagctcttttacacttttttgctgactcctggtctggtttctatttttagtgcaaagtctttaacttctctcatgaggctacttgttcctaaagtttcaggttccaaatacttgtgagattttcttgatttttagcaaaaggagcttactttggaggtctgtgtctaggtccacaccagtgccccagcaggcattgtgtaagtagtgaataaaacgctgacactcccgcagtgtccgcaggataaaatactgggtgaggtgaggatactaatcaaaccagctatttcaagcttct

SEQ ID NO: 366720 - DNA, 3818 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366721 - DNA, 4124 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366722 - DNA, 3764 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366723 - DNA, 3443 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtgaccaatttatgacgtttggttgtctgttttagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366724 - DNA, 2830 bp, Homo sapiens
actatttaatcttatttcacttaggaccttggttatttatattagttgtctataggcagtggaacataattaaataccattttctagttaaattcacctaagacaacttttaaacaaaactcttgcgttaaatgttgccattaatgaagcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366725 - DNA, 3765 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaatggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366726 - DNA, 3764 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366727 - DNA, 2886 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatcca

SEQ ID NO: 366728 - DNA, 1621 bp, Homo sapiens
ctctagaggatacacctccataacggtgcccacatagtattcttatgggttaaattgaggcctcctcaaaagatgttgaaatcctaaattctagtagctcagaatgtgaccttatttagcaatagagttattgcgggtcgggcgtggtggctcatgcctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaagaaagaaacaaaaaccaaaaaccaggaggaaggagtctctatcctccataacctcactgaagatctcacctgaagacgtcaggcccaccctgaataatcagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366729 - DNA, 2516 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatctaataaggagtggtgcaccactcctatagatcagttcattttaaacatgtttgggtgaaaatgatgtgtcaatgtaggtacatgtattacaattgatgacctttcattgacgcatcataatgacttacagttcatagtttatattaagatcattcttggtgttgtacattctgtgggtttggacaaatgtataatgaccatgtatccagcattataatatcagacagagtattttcac

SEQ ID NO: 366730 - DNA, 2139 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggaatgatcccgattctgaactcgaacccagttcaggatccgtctagagta

SEQ ID NO: 366731 - DNA, 2335 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctaatttcatttgaaattgtttaccctttgcaataaaatgtttctccatcaaccctattctt

SEQ ID NO: 366732 - DNA, 1315 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagattaggctgtcctgggttcacactgcccgaggtcaaacccaacccagtggaaggaggagcttccaagtccctcttctttccagatgaagcaataaacaagcaccctcgcttcaggtgagtatggctttgtgttgaaatgcagatgcccttcactagacccctgacttctgagagtatagtatttctgtctagaaatcctttttgagcattaactgagttttggctctcttcctaagtaaccagagaagatagcagatgtgcacctgttcacatcttcagtacccccaggcttcttggttgttgatgcgtgcaccaggcttgatttgtcaattctccaagtcgtcacaaagttattcgctgagccactgcgaataactcttttaatagggagattattttcagtcctaggtctgt

SEQ ID NO: 366733 - DNA, 1202 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtgagcgcccgcggtccccgtccccgccgggcacccgtgtctggccgcccgcgctgcctttgtcttgccctacgcccccggccctatcgcggtccgcgttctccactgcgcccgggggtcctcgagcgcctcccggccccgggagcatcgtccctgctttcgcctagtccgcgtccagggccatcctcctgactagactcctttcttgttcattcattcttttgggttttccccttcattccataaacacggattgggcgctgggagggcgtgagcatgaaaaagtgacattaggtgctgcgagtcttcaacctagtgtatctgcagaccggcaactaccatgatccaccttacaggctcaaaattcgcttttgcggtcaatatgaaagagatttaagttttcctagtaggcctgctgcttttagaaatcaggtcttcaggatgtccacttctgccctacctcatgcaggtgtcttttccttaaacctctccaacttctcatcttccctcccctccaaaacacacacacttcatagctataaattgaaaccagtaaatta

SEQ ID NO: 366734 - DNA, 3016 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctga

SEQ ID NO: 366735 - DNA, 3203 bp, Homo sapiens
ccagagtatcactcgttagtacagatgaaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366736 - DNA, 3760 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaa

SEQ ID NO: 366737 - DNA, 3836 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgtttttttttctcaactagttaagtcaactgcttctgaaataactctgtattgtagattatgcagatctttacaggcataaatatttaaactgtaatatgctaacttgaagagattgcaataaagctgcttcagctaaaaaaaaaaaaaaaaaaaaaacttttgggggcgctggcccggaaaaggttttaaaccttgcgttggggcggccccgtggtatgtaaccgcgccacgacggttccaggacccggccgaccggtggttccccaaaaaaaccgcggccccgttcgacacccggtcgcgcctgggtcacacagccggcaacacccccgcggggg

SEQ ID NO: 366738 - DNA, 2029 bp, Homo sapiens
agtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctaatttcatttgaaattgtttaccctttgcaataaaatgtttctccatcaaccctattctt

SEQ ID NO: 366739 - DNA, 112 bp, Homo sapiens
gttgtggcaaggcccagaacagcacggagctcgctgcagaggagtacaccctcatgagcatagacaccatcatcaatgggaaggtaggagggtggccctgtacagtacccct

SEQ ID NO: 366740 - DNA, 466 bp, Homo sapiens
gcctcagacatttccaagaaatgttcttcctaagtagctttatgctgctatggcaatacagggtgacttccttggatttagcagtagtcaatggaaaaaaaaaaaaagcgaggactgctcctgttaattgcatcctgctgtctagattgcctgtcactctcttctctacataccccaggccatttgttgcagccaagctactagatttctcttcctttccttacatatagaaaactggttaaatgtgtcctattctgagaatttgccctgagtagagcatttctgaatttcagtccacaaaaaacacatgccagaatcatactaggattcaaaaccccagccctgccacttagtggctgtgtgagttttggcaaattgctttaattgttctgagcttattttcacatctgtaaagtgagactgaaagaggttaataaaagccacttcaaagagctgtgaagtggat

SEQ ID NO: 366741 - DNA, 1557 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366742 - DNA, 1388 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgaggccacctcacctcccatccctgcctgggcctccccgcagctcctgggtggttgagcttcagttccaattttaaggcgactgtccattcatccctgggcctcgtctttcctggcccatcccaccg

SEQ ID NO: 366743 - DNA, 1033 bp, Homo sapiens
tgcttgaacccgggaggtggaggttgcaatgagccaagatagtgccactacactccagtctgggtgacagagcaagactgtctcaaaaaaagaaaaagaaaggggagaggaactcacagggcctcagatgtcctctgctcaccccaaccagtcccctgcaaactccctttctccccacaggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366744 - DNA, 938 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtgaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366745 - DNA, 1287 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggaaaaatg

SEQ ID NO: 366746 - DNA, 1183 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagacctgagaagccaggagacctgagcaggagacctgagcagcc

SEQ ID NO: 366747 - DNA, 1276 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggggacctgagaggcgagaccactcgcgcccctgggttgcaaagttggggtctttattggcctccgggattctgctcctggcggtttctccaggctggtgatgggcaagccgggtgtaccaagtccatgatgcacatgaggagcatttgtagccatcactgaatcacctcatgactagcgggacaagcctcaaattcaccgcaggatttccggtaggttggattgtggggttggtgtttgcactccaaagaggtgctgtgatttccctgtgtctgtctgtctttctggcttgtcctgttcg

SEQ ID NO: 366748 - DNA, 1215 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggaaaaatg

SEQ ID NO: 366749 - DNA, 1022 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaacccggagggagaaaaaaatgaggaaccagtcattaaaggagctgtttcctgggta

SEQ ID NO: 366750 - DNA, 2537 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggaggtgagatgagggcttccctgcctcattcaggctccacctgggattggtccctgctcccccatcccaccctgcccagcccttcccttctccaattcctgtgtgggcctggtgcaggcactgcctctctctggccttcagtttcctcatctgtaaaacaaggtcttaatttttttttttttttttttgatacagagcctcactctgtcccctaggctgaagtgcagtggcacgatctcggctctgccttgggggttcaagcaattctgcctcagcctcccaagtagctgggattacaggtgtgcaccaccacgcccagctaatttttttgtatttttagtagggacgggttttgccatgttggccaggctggtcttgaaatcctgacctcaggtgatcctcccgccttaccctcccaaagtgctgggattacaggcgtgagccactgtgcccggttggaagctgaacatttcatgaggttggcttcttgctgcagcgggaaaataagcagtgtttctggttttcctcctgtcaaacccagtacaaacactttgtgtgctgacttcccttccaaaatagctaacatttcttcagcagtgccaggcgtggcttttggcacttacagagcattccagagtattctctgatcttcaaagtcataccatcctccccactttattattatttttttgagacagggtcttgctcttttgctgaggctggagtgcagtggtgctatcacaggttactgaagcctcaacttgacaggctcaggcagtcctcctgcctcagcctcccgagcagctgagactaaaggcacgcgccaccacacctggctaatttttaattttttgtggagacaacaccttgctatgttgtcccggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagt

SEQ ID NO: 366751 - DNA, 1051 bp, Homo sapiens
tggcgcgatctcggctcactgcaacctctgcctcccgggttcaagcgattctcctgcctcagcctccacagtagttgggattacaggatcacgtgataaggcactagcagatgtggttggaatccttgctgtgctgaatcctggctgtgtgaccccaagctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366752 - DNA, 982 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366753 - DNA, 515 bp, Homo sapiens
tgagatggagtctcactctcttgcccaggctggagtgcaatgacatgatctcggctcactgcaacctctgcctcccaggttcaagtgattctcctgcctgagcctcctgagtagctgggactacaggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggaaaaatg

SEQ ID NO: 366754 - DNA, 272 bp, Homo sapiens
tagtagaaacgaggtttcaccatgttggccaggctggtctcgaactcctgacctcagatgatctgcctgcctcatcatcccaaagtgctgggattacaggcgtgagccaccgcgcccggcctagtattggcaattcttatgactgaccataatgaagcaaatctataatctgatacctcacctcccggctgccctgtatcctgttatcccagccccgaggaagctgggcggtacctggagacctacaaggcctatgagcagaaaccagcgga

SEQ ID NO: 366755 - DNA, 1600 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtg

SEQ ID NO: 366756 - DNA, 1154 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366757 - DNA, 1515 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366758 - DNA, 1123 bp, Homo sapiens
tggcgcgatctcggctcactgcaacctctgcctcccgggttcaagcgattctcctgcctcagcctccacagtagttgggattacaggatcacgtgataaggcactagcagatgtggttggaatccttgctgtgctgaatcctggctgtgtgaccccaagctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366759 - DNA, 1461 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcattcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366760 - DNA, 1594 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagggcccctggcacctgttctccccttgaagcccaagtctcttcccctcttcatgaagaagccaggggtctggtcttctagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366761 - DNA, 1197 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtg

SEQ ID NO: 366762 - DNA, 1648 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggaaaaatg

SEQ ID NO: 366763 - DNA, 1082 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366764 - DNA, 1485 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctg

SEQ ID NO: 366765 - DNA, 1173 bp, Homo sapiens
ggcggggcgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgaagatagagaggatcatacagaaatattcatggaactaaataaacatttacaattacatgacaataatgcgatgaacataaacataatgac

SEQ ID NO: 366766 - DNA, 1430 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgaggccacctcacctcccatccctgcctgggcctccccgcagctcctgggtggttgagcttcagttccaattttaaggcgactgtccattcatccctgggcctcgtctttcctggcccatcccaccg

SEQ ID NO: 366767 - DNA, 1274 bp, Homo sapiens
cagcactgggaacgtgtctgcgtcccttactgaaccgtaagctccgggaggacaacacggggctgtcgttggtcactgctgtgtcaccagcacggactcgcacaggaccgggaagagaggaagcgcgtggggggaataggtgtggaataaatgaatgaatgaggaaactgaagccaagtcaatgtctgagttggattcaaacttaagtctctccttactgagaggagggaccaagttggatctcctgcgatctgttctccactgagccctgccaggattctgggcacacagaagcgctcagtaagggctttgaaacttaacagtttgggagccagatcctcaggccacatctctctcctcccacgacctccgcggtcctccagaaccatagagagttgtacagagatcgccctgctctatgctctactctcctggggagcggggccagagaggccggaagtgctgcgagccctgggccacgctggccgtgctggcagtgggccgcctcgatccctctgcagtctttcccttgaggctccaagaccagcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggaggcccggaggctgtttgatgtcctgcacgagcccttcttgaaagtaccctgatgaccccagctgccaaggaaacccccagtgtaataataaatcgtcctcccaggccaggctcctg

SEQ ID NO: 366768 - DNA, 1620 bp, Homo sapiens
tgcaatggcgctatcttggctcactgcaacgtctgcctcccgggttcaagcagttcccccacctcagcttccctagtagctgggattacaggcacctgccaccacgcctggctaatttttgtaattcctggcttcttggtttctaattctgattttctcctccagaaagatccccagcaggccctcaaggagctggctaagatgtgtatcctggccgactgcacattgatcctcgcctggaggtgagatgagggcttccctgcctcattcaggctccacctgggattggtccctgctcccccatcccaccctgcccagcccttcccttctccaattcctgtgtgggcctggtgcaggcactgcctctctctggccttcagtttcctcatctgtaaaacaaggtcttaatttttttttttttttttttgatacagagcctcactctgtcccctaggctgaagtgcagtggcacgatctcggctctgccttgggggttcaagcaattctgcctcagcctcccaagtagctgggattacaggtgtgcaccaccacgcccagctaatttttttgtatttttagtagggacgggttttgccatgttggccaggctggtcttgaaatcctgacctcaggtgatcctcccgccttaccctcccaaagtgctgggattacaggcgtgagccactgtgcccggttggaagctgaacatttcatgaggttggcttcttgctgcagcgggaaaataagcagtgtttctggttttcctcctgtcaaacccagtacaaacactttgtgtgctgacttcccttccaaaatagctaacatttcttcagcagtgccaggcgtggcttttggcacttacagagcattccagagtattctctgatcttcaaagtcataccatcctccccactttattattatttttttgagacagggtcttgctcttttgctgaggctggagtgcagtggtgctatcacaggttactgaagcctcaacttgacaggctcaggcagtcctcctgcctcagcctcccgagcagctgagactaaaggcacgcgccaccacacctggctaatttttaattttttgtggagacaacaccttgctatgttgtcccggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagt

SEQ ID NO: 366769 - DNA, 571 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacgggtaccgggtcccggagaagacgcgcgctgcaaagcaatggttccacttgaccaatcttcggatcagagcgacaatcgcgtcgagaactaaaatacacgctctgggtctgaaccaggacttttgctgcttcgatggatccggacctg

SEQ ID NO: 366770 - DNA, 2536 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366771 - DNA, 2508 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagaaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366772 - DNA, 2513 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctgagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366773 - DNA, 2594 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgtgggcagtaaatgcttatcagtgagtaactggagaacaacatggcccttccttataggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366774 - DNA, 2377 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagactgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366775 - DNA, 2453 bp, Homo sapiens
cggcctcctcgtggtccgacctgcggtttgggcccgcggctggtggggcccggcgactccatgggcctcagtttctcctctggtaacgtgagcttcgcttccagagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366776 - DNA, 2992 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366777 - DNA, 3577 bp, Homo sapiens
tcaggctcggtcccccggttactgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaatagtaaaaacaattttttttttctgacaatctcttgtcacccaggctggagtacaatggcgcaatctcggctcactgcaaccgccgcctcctaggttcaagcgattctcctgcctcagcctccagagtagctgggattacaggcatgtgccaccacgcctggctaatttttgtatttttagtagagacagggtttcacgatgttggccaggctgctctcgaactcctgacctcaaatgatccaccaccccccttggcctccccaagtgctgggattacaggtgtgagccatcgtgcctagctaaaaacacttaatccaaaattcttaccatggcctgcaaggtcctgtgtaacctggcttcgtcccccctctaaatgctatgaatgtcagatgggcaccgtaaatgtgtgaagggtcagttacctgggtgtaaggcagtagaaggtggggacagaagtgagctggagggcgggcttgtgtcctgcctgcaggatggggggtggctgctacttattcaggaatccagcagaaattgcttcacagaagctagaagtgagcaacttaaataactaaacactatctggaccaaacaaaacactaaggtcggcccgatgcagtccactactctcttattggcagcttctggctcactgttgaacccactggaatgagagcaccaccgggcagactcctggaccatcccactgtcagctctgtggtccaggcacagtacctgggacagtgtaagcactcaatgtgaaactcaagccaggggcaagccacagacctcccagtatcttctccgcgcatcttcccactcccagtctccattgtggttttgtatgttcctaaccacagacttttggcaatgctgtgcacacaaggcctgaggagtatttccttggcaattgtcagaagaatgagactaaaacacttcctttgcgcacctgttcttagaagcagctctggcattactcccgttgtgtatccaggacaggaagtggcagtagaatgttgagttactgaagtcagatgtcttcagttccagttccagctggagagcagatagtaggtccgttgacctctctgagcttgtttcctcagctgcaaaataagaatgaatcctgtgctacccaccttgccatgttgtgtttcagtgagacgagaaaacactaccaaaaagtcattccacagacttctgaggacagaaagtgccctcactcaagcttctcttgtaaccacagagaaggtgtctggatattaacatagagcagaggccaccaaggtttttcttttttttaatcaaaaatcctgcatgtgaaggcagtaattgtatcttaatattataatttcaacatctgtgggtgtgaaatttttcaaaaaaaaaatttggggaaatattttaaatggc

SEQ ID NO: 366778 - DNA, 2472 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctaaaaaaaaaaaaaaaaaaaaaaaaaaaaaaaacaaaaaaaaaaaacaaaaaaaaaaaaaggggggcgcgcgcgcgccctcaagagagttttccccgcggggggcccccgtcgtcccgggcctcacccgagcattcttcggggacaacaagggggcccccaaaagagaggaggcgccatataatacacccacgagcccgggggcgcggtattaacaacaggccagagcggggaaacaaaggggagcagccagcgggagcatttcgctgtgaaacaggagaccctactaactattgggggcgtggtgagaacaaaattggggggcacaaaaattccccttacaggaatatttaagacagccctccaggggacaatatattaaaattttccagaggttacatatgtcgt

SEQ ID NO: 366779 - DNA, 2442 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaaggagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366780 - DNA, 672 bp, Homo sapiens
cagggccgctagagatggttgtgcacattactccctacatagggatgtctggccaaggatccacactccactggccgtgctgtgtacccgcccagcagcatcacccaacccagagagtgcgccttttccactctacatgaaggtgctctgtggacttactgtaaacagcctcctcagtagtcagtcagtagtagagacagaatccaaacccaggtctgattccaaagcctctgttttgtttctgttttctgtttgtttttttttgagacagggtcttgctctgtcactcaggatggaatgcagtagtgttgtgatcatagcttactgcagcctcgaactcctgggctcaaatgatccaaagcattgggattacaggcatgagccaccatacccagccagccaaagcctctgtttttgcccatatcacactcattctcctccagaagacaagggccatatctggttaatctcctgctgttccactcaatgcctggctcatcataggtgggcagtaaatgcttatcagtgagtaactggagaacaacatggcccttccttataggccaaaaagcaaatggatttccacctgacaaatcttcgggatccaagaagcagaaacaatatcagcggattcggaaggagaagcctcaacaacacaacttcacccaccgc

SEQ ID NO: 366781 - DNA, 4476 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaatagtaaaaacaattttttttttctgacaatctcttgtcacccaggctggagtacaatggcgcaatctcggctcactgcaaccgccgcctcctaggttcaagcgattctcctgcctcagcctccagagtagctgggattacaggcatgtgccaccacgcctggctaatttttgtatttttagtagagacagggtttcacgatgttggccaggctgctctcgaactcctgacctcaaatgatccaccaccccccttggcctccccaagtgctgggattacaggtgtgagccatcgtgcctagctaaaaacacttaatccaaaattcttaccatggcctgcaaggtcctgtgtaacctggcttcgtcccccctctaaatgctatgaatgtcagatgggcaccgtaaatgtgtgaagggtcagttacctgggtgtaaggcagtagaaggtggggacagaagtgagctggagggcgggcttgtgtcctgcctgcaggatggggggtggctgctacttattcaggaatccagcagaaattgcttcacagaagctagaagtgagcaacttaaataactaaacactatctggaccaaacaaaacactaaggtcggcccgatgcagtccactactctcttattggcagcttctggctcactgttgaacccactggaatgagagcaccaccgggcagactcctggaccatcccactgtcagctctgtggtccaggcacagtacctgggacagtgtaagcactcaatgtgaaactcaagccaggggcaagccacagacctcccagtatcttctccgcgcatcttcccactcccagtctccattgtggttttgtatgttcctaaccacagacttttggcaatgctgtgcacacaaggcctgaggagtatttccttggcaattgtcagaagaatgagactaaaacacttcctttgcgcacctgttcttagaagcagctctggcattactcccgttgtgtatccaggacaggaagtggcagtagaatgttgagttactgaagtcagatgtcttcagttccagttccagctggagagcagatagtaggtccgttgacctctctgagcttgtttcctcagctgcaaaataagaatgaatcctgtgctacccaccttgccatgttgtgtttcagtgagacgagaaaacactaccaaaaagtcattccacagacttctgaggacagaaagtgccctcactcaagcttctcttgtaaccacagagaaggtgtctggatattaacatagagcagaggccaccaaggtttttcttttttttaatcaaaaatcctgcatgtgaaggcagtaattgtatcttaatattataatttcaacatctgtgggtgtgaaatttttcaaaaaaaaaatttggggaaatattttaaatggc

SEQ ID NO: 366782 - DNA, 2697 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366783 - DNA, 3255 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaacca

SEQ ID NO: 366784 - DNA, 2676 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacaacaaacaccaaccatcaaaaaacacccgggttttcttttgtggggcgggagagagatttaaaatgccagggcctttttctctccccctctttacaagggggaatcccgccatgagggaattatccgacactcaaaaac

SEQ ID NO: 366785 - DNA, 2297 bp, Homo sapiens
cggcctcctcgtggtccgacctgcggtttgggcccgcggctggtggggcccggcgactccatgggcctcagtttctcctctgggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366786 - DNA, 4451 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaatagtaaaaacaattttttttttctgacaatctcttgtcacccaggctggagtacaatggcgcaatctcggctcactgcaaccgccgcctcctaggttcaagcgattctcctgcctcagcctccagagtagctgggattacaggcatgtgccaccacgcctggctaatttttgtatttttagtagagacagggtttcacgatgttggccaggctgctctcgaactcctgacctcaaatgatccaccaccccccttggcctccccaagtgctgggattacaggtgtgagccatcgtgcctagctaaaaacacttaatccaaaattcttaccatggcctgcaaggtcctgtgtaacctggcttcgtcccccctctaaatgctatgaatgtcagatgggcaccgtaaatgtgtgaagggtcagttacctgggtgtaaggcagtagaaggtggggacagaagtgagctggagggcgggcttgtgtcctgcctgcaggatggggggtggctgctacttattcaggaatccagcagaaattgcttcacagaagctagaagtgagcaacttaaataactaaacactatctggaccaaacaaaacactaaggtcggcccgatgcagtccactactctcttattggcagcttctggctcactgttgaacccactggaatgagagcaccaccgggcagactcctggaccatcccactgtcagctctgtggtccaggcacagtacctgggacagtgtaagcactcaatgtgaaactcaagccaggggcaagccacagacctcccagtatcttctccgcgcatcttcccactcccagtctccattgtggttttgtatgttcctaaccacagacttttggcaatgctgtgcacacaaggcctgaggagtatttccttggcaattgtcagaagaatgagactaaaacacttcctttgcgcacctgttcttagaagcagctctggcattactcccgttgtgtatccaggacaggaagtggcagtagaatgttgagttactgaagtcagatgtcttcagttccagttccagctggagagcagatagtaggtccgttgacctctctgagcttgtttcctcagctgcaaaataagaatgaatcctgtgctacccaccttgccatgttgtgtttcagtgagacgagaaaacactaccaaaaagtcattccacagacttctgaggacagaaagtgccctcactcaagcttctcttgtaaccacagagaaggtgtctggatattaacatagagcagaggccaccaaggtttttcttttttttaatcaaaaatcctgcatgtgaaggcagtaattgtatcttaatattataatttcaacatctgtgggtgtgaaatttttcaaaaaaaaaatttggggaaatattttaaatggc

SEQ ID NO: 366787 - DNA, 4382 bp, Homo sapiens
ggcccctcgaggcgctctaacccaggctccgccctcgacttgctctaataaccaggctgcgctcctcgagatgctctaacggccaggccccgccttcaaatgctctaactccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaaggagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaatagtaaaaacaattttttttttctgacaatctcttgtcacccaggctggagtacaatggcgcaatctcggctcactgcaaccgccgcctcctaggttcaagcgattctcctgcctcagcctccagagtagctgggattacaggcatgtgccaccacgcctggctaatttttgtatttttagtagagacagggtttcacgatgttggccaggctgctctcgaactcctgacctcaaatgatccaccaccccccttggcctccccaagtgctgggattacaggtgtgagccatcgtgcctagctaaaaacacttaatccaaaattcttaccatggcctgcaaggtcctgtgtaacctggcttcgtcccccctctaaatgctatgaatgtcagatgggcaccgtaaatgtgtgaagggtcagttacctgggtgtaaggcagtagaaggtggggacagaagtgagctggagggcgggcttgtgtcctgcctgcaggatggggggtggctgctacttattcaggaatccagcagaaattgcttcacagaagctagaagtgagcaacttaaataactaaacactatctggaccaaacaaaacactaaggtcggcccgatgcagtccactactctcttattggcagcttctggctcactgttgaacccactggaatgagagcaccaccgggcagactcctggaccatcccactgtcagctctgtggtccaggcacagtacctgggacagtgtaagcactcaatgtgaaactcaagccaggggcaagccacagacctcccagtatcttctccgcgcatcttcccactcccagtctccattgtggttttgtatgttcctaaccacagacttttggcaatgctgtgcacacaaggcctgaggagtatttccttggcaattgtcagaagaatgagactaaaacacttcctttgcgcacctgttcttagaagcagctctggcattactcccgttgtgtatccaggacaggaagtggcagtagaatgttgagttactgaagtcagatgtcttcagttccagttccagctggagagcagatagtaggtccgttgacctctctgagcttgtttcctcagctgcaaaataagaatgaatcctgtgctacccaccttgccatgttgtgtttcagtgagacgagaaaacactaccaaaaagtcattccacagacttctgaggacagaaagtgccctcactcaagcttctcttgtaaccacagagaaggtgtctggatattaacatagagcagaggccaccaaggtttttcttttttttaatcaaaaatcctgcatgtgaaggcagtaattgtatcttaatattataatttcaacatctgtgggtgtgaaatttttcaaaaaaaaaatttggggaaatattttaaatggc

SEQ ID NO: 366788 - DNA, 1519 bp, Homo sapiens
ttttacaggaacaacatgctccgaaaatgaagttttaaaggcttctgggttgtatggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaata

SEQ ID NO: 366789 - DNA, 971 bp, Homo sapiens
tgagacggagtctcactctgtcgcccaggctggagtgcagtggcatgatcttggctcactgcaacccctgcctatcgggttcaagcaattctcccgcctcagcctcctgagtagctgggattacaggcacacgccactacacctggctgatttttgtatttttagtagagacggggtttcaccatgttggtcaggctgatctggaactcctgacttcgtgatccgcctgcctcggcctcccaaagttctgggattacaggcgtgagccactgcgcccagccaggaactggctttttaaaggaattttgtgtggacccttttacaaataaccataattctttttttattttttctgagacagagtctcgctgtgttgctcaggctgaagtgattctcctgtctcagcctccttcacctcccaggttcaagtaattctcctgtctcagcctcccgagtagctgggatacaggcacacaccaccatgcctggctagtttttttgtatttttagtagagacaggggtttcaccatgttggccaggctggtcttgaactcctgacctcaggtgatctacccgcctcggcctcccaaaatgttggcattacaggccaccacacccggcaataactgattcttaatgcacctggttcttaggtttggatttggggtttcaaattcaaatcaaagtctcctggggtataagggcccttggagatcatttgaaccaagctctagctcctttggtcttggggacagctccaattactagaacatgatttaaattgagccacacagtcctttgcctggggattttgcagcctgtacttactggaggcatttccgtgttcgcacagcaggcccttctgatcagctctcaggccttgctgacctcctgggccaacactgagccattagcccctgtcagctatgtcttgctggtggctttagtagggacataggagggcctctca

SEQ ID NO: 366790 - DNA, 3008 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgagtcccgagtgtgtcatgcgccatcggcagcccttcccccacatgtccactgaatgcaggagactcgatgccttgtgataacccaacacctccatcttttctgacccataatttggcacaagttccttccctgccactttgctttcctccggcgttccctcatgttccaggagaatgcaagtcctgtcacataaaccaggtggtctaagcagaccccttctgggtctgagccacagctcactcaagctctgggttccttgggacagagttcagattagcccatggatcaggtgatgtgcaggacatgaaaaggttagatgggcgggcagcgtgatgtctcacccactgcttctgagcaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366791 - DNA, 2625 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagagcccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366792 - DNA, 2368 bp, Homo sapiens
tcctatacacacatacctatggtaaagtttaatttataaattaggcacagtaaaaaattaaagataacataaaatagaataattatgacaatatactgtaataaaagttatgtgaatgtggtctctctctctctcctctctctaaatatcttcttgtactcacctattctcaaactgtagataactgaaattgcagaaagcaaaactgtggataaggttggggctactgcaactcagccaaggacttacagtggcagacctggaatgcaaacccaggcagtctgataccagggtttctccacctgtgttctgccacatgggatggataggatggatgggtgtacggatggacggacggacagacggatggacaaatggattgaaggatgggtaggggagtcatcagatgtgttctccaacaccatgtacagtacctggcacatagcaaatctatgataaacatttgatagtaagtgaataatgaatgtcagtgccagtgttggtgtggccttaggttattctttccaggtgttgtatctgatgctggcctcatatgtttgtctcacttggctgactagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366793 - DNA, 2037 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366794 - DNA, 2212 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagaagcaggaagcagcaggaagcggcagaagcaggaagcaggcagaagcaggaagcagcagaagcaggaagcggcagaacagaacg

SEQ ID NO: 366795 - DNA, 1872 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcct

SEQ ID NO: 366796 - DNA, 1511 bp, Homo sapiens
agctgagccatacctgcatcccagcactgttctgccactccgttaactgctctctgtacgtggcctgctatcttggtgcgcagtgaaggttagaataacagctgcaaccagttatgaaatgatagaggagactacttacctggttcaagggaccagatagctgtgcacaagaggcactaggctttccacccagggggaaaggctatttcaacaatgcatgctgccccatgcagaggtgtacacatggaaaagcttggagcacgggtaggggacaggcagtatttgtcacctgagtgaagggcatcagtaggagatagggtagaggaagaattgggttgggaccagagaagggaagaccctcactaacaaagcaggctttgggttgagactgtgttaacagatgttctagctacagcttcccttcctgttgcagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366797 - DNA, 1905 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaaggtgaggctgtccccggcttcgaggggacggtgtgggtagaaacctctgttctcgttccagagtgaaggtcaggtttgggccagagccacagtgacagatcctctgtgttaggaaggtaaaggctagttacaagagaacaaaaaacagattttaatgtaggtaggagtaggagcactagccaccacagcatagtcagaatcctagcagttcaactcctgtggcttttttagttgctgaaaaagttgttcagaggccagacacggtggcttacacctataatcacagctccaattactagaacatgatttaaattgagccacacagtcctttgctgggg

SEQ ID NO: 366798 - DNA, 849 bp, Homo sapiens
ttcaagaccagcctggacaacatagggagacctcatctctacaataaaattggctgggcgcggtagtgcgcagacctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366799 - DNA, 1666 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcct

SEQ ID NO: 366800 - DNA, 2646 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366801 - DNA, 2827 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactgagctgttctagttttctcttccccagcactgtcatctagattttccatttcagtaattcccacccctcggtctactagcaacaacaactttcttgtatcctttgaggagacgttagggagaaccatcatcatttcacagttaaaagaaagacagtccagtcctaggcaaaatttcatgaagc

SEQ ID NO: 366802 - DNA, 2598 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcgctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366803 - DNA, 2581 bp, Homo sapiens
  misc_feature (2508)..(2508): n is a, c, g, or t
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaacttgcaaaaaaaaaaaaaaaaaacttcagggggggccccggtccccaattcgccttatgangaggcgtatttcaattcacttggccggcggtttaaacgttgggactgggaaaaacctgggcgttaccaaactg

SEQ ID NO: 366804 - DNA, 1774 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctggggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 366805 - DNA, 2623 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactgagctgttctagttttctcttccccagcactgtcatctagattttccatttcagtaattcccacccctcggtctactagcaacaacaactttcttgtatcctttgaggagacgttagggagaaccatcatcatttcacagttaaaagaaagacagtccagtcctaggcaaaatttcatgaagc

SEQ ID NO: 366806 - DNA, 2107 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaaggtgaggctgtccccggcttcgaggggacggtgtgggtagaaacctctgttctcgttccagagtgaaggtcaggtttgggccagagccacagtgacagatcctctgtgttaggaaggtaaaggctagttacaagagaacaaaaaacagattttaatgtaggtaggagtaggagcactagccaccacagcatagtcagaatcctagcagttcaactcctgtggcttttttagttgctgaaaaagttgttcagaggccagacacggtggcttacacctataatcacagcactttgggaggctgaggcgggtggatcacttgggaccaggagttccagtccagcctggccaacatggtaaaaccccgtctgtactaaaaatacaaaaattagctgagtgtcgtggcacacgcctgtaattccaggtactcgggaggctgaagtaggagaatcgtttgaaccctggaggcagaggttgcagtgagccaagattgcaccactgcactctggcctaggtgacagtgcaagtctttgtctcaaaaaa

SEQ ID NO: 366807 - DNA, 1726 bp, Homo sapiens
cccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccaggtaggaacctgctgcaccatcagagctctccaggggcactagagggtgggtcaggagcatttaggactgactcttcaggtcctctctggttttgtgttctaagtcatgtctttatttagctccgcacacaagaggttagcaatctctcccttagaacggggtttttttttctctctttgcagagagacagcacttcccaagttcctttctctagcccacttaaagaacaaggacctcagtgctgcaagttttcctaggtaaataaagaggcccggcacagtggctgacacctgtaatcccaacactttgggaggcttgcttgaggattgcttgaggccagcagtttgagaccagcctgggaaacagagtgagatcccttcttggaggcatttccgtgttcgcacagcaggcccttctgatcagctctcaggccttgctgacctcctgggccaacactgagccattagcccctgtcagctatgtcttgctggtggctttagtagggacataggagggcctctca

SEQ ID NO: 366808 - DNA, 1208 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366809 - DNA, 1840 bp, Homo sapiens
agtgcagacacgtgatgcgggggagggcggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagacgtgtccctgtccctggaaacgcaggcaccgcgtgtttggaaagacattcatctgggctgtttgacagactccccagttggtgccatgctctgtgcttagggaactgtgagacccctggaggggtgggtaccgggaccgcactcagcctggggtttggaggcggcctcctataggaagcgacctgggacctaagatttttagactgactgtgggttcactggaataaaaaggaagaaacaaagagcattgcaggcatcgggactgtcacatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366810 - DNA, 805 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagatcccggggttttaacccgcaatggtgggatataaaaataccattcccggttcggggagct

SEQ ID NO: 366811 - DNA, 872 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaagaaatgaagtggacagacttagccttacagtatctccatgagcaatgttccccccattggaaactgacgcttggctcctttcttgtggatggatcttctcaaagtacacagataaagcgtggttgttcagtctccaaattcaaaacctttgagtaataaatcagccctccaaaaatgttcacc

SEQ ID NO: 366812 - DNA, 915 bp, Homo sapiens
  misc_feature (706)..(706): n is a, c, g, or t
  misc_feature (713)..(713): n is a, c, g, or t
  misc_feature (723)..(723): n is a, c, g, or t
aaggatagaaggcctactgaagctcgagtgatttgagaaaactttacaaaggtggaaaatctacgtgggcctccgaaagtcagatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaagatttnattctcntattccaatnggagcttcgaggtttagctgtatgtgtgttgcattcccttcctgtcgggtctaagatttcggtttcacctgggatccggtacgtgggacggcttcaacttggggagactgggggagagttactccctgtaaccaggtttttgtttaccttcttggtgtctcatggttttttctgtgcgtcttcttgtgctgg

SEQ ID NO: 366813 - DNA, 436 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgta

SEQ ID NO: 366814 - DNA, 1656 bp, Homo sapiens
  misc_feature (1210)..(1210): n is a, c, g, or t
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttanaaaaaaaaaaaaaaaaaaaaaaaaaaaaaaaaaaaaacaaaaaaaaaaaaaaaaagagaaaaacacaccaacaaacaaaaaaaaaaaaaaaaaaaaaagggatgggcgcgggccggcccgcgcgcgcccaacgagacgagtgttaaaacacactggtgggggggggacggcgccccatgtaggtgagagaggaggaggaccagcggtgccacaagagaagaccgcggctagaagaaaaaagaggaggggagaggatccccacacaccaagaaagcacagacgcggcgggggggaaacaacggcggagggtagtcgagacgacacaactacaggagggagagatcgcgaggacaatcaagagaggcgtgataacacaaaggagggagggactacaagagaggggacgacagataaaaaaagcgccgcacgaggggggggtgggtgat

SEQ ID NO: 366815 - DNA, 1645 bp, Homo sapiens
agtgcagacacgtgatgcgggggagggcggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagatttttagactgactgtgggttcactggaataaaaaggaagaaacaaagagcattgcaggcatcgggactgtcacatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366816 - DNA, 1472 bp, Homo sapiens
aaacaggaaaaggtgaatgttcaagttagaagagaagagctacattgagatgcaacatattaatatttgagggcctcgtttaacgtgttgctctcctgtcacactctatgacactggtctgtcagctgggctatgcctgtccagtatacactataaaatatgtatcagttggggttggagagaggaactgtgatcaaagtagtcacccggcccatatgagaaaatgaaccttttcccaaaaggtggccccagactaaaaagcctggagaatcctaatagtggattataccatctcttcagtcttcgtgtttaagaaataacctctttggcttacagatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366817 - DNA, 1267 bp, Homo sapiens
cacactaaatgagcgggtccccttgtgccgtgaatgaagtagtcccaacagcgctagctagacagcagccctggcagggaggccgcactggggtctctccgctgaaaaggaaggtgggtccgccggggaagatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366818 - DNA, 1786 bp, Homo sapiens
agtgcagacacgtgatgcgggggagggcggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagacgtgtccctgtccctggaaacgcaggcaccgcgtgtttggaaagacattcatctgggctgtttgacagactccccagttggtgccatgctctgtgcttagggaactgtgagacccctggaggggtgggtaccgggaccgcactcagcctggggtttggaggcggcctcctataggaagcgacctgggacctaagatttttagactgactgtgggttcactggaataaaaaggaagaaacaaagagcattgcaggcatcgggactgtcacatttgacaagatcaaagctgcagggcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366819 - DNA, 1764 bp, Homo sapiens
agtgcagacacgtgatgcgggggagggcggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagacgtgtccctgtccctggaaacgcaggcaccgcgtgtttggaaagacattcatctgggctgtttgacagactccccagttggtgccatgctctgtgcttagggaactgtgagacccctggaggggtgggtaccgggaccgcactcagcctggggtttggaggcggcctcctataggaagcgacctgggacctaagatttttagactgactgtgggttcactggaataaaaaggaagaaacaaagagcattgcaggcatcgggactgtcacatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaatggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366820 - DNA, 986 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagatggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366821 - DNA, 1068 bp, Homo sapiens
agtgcagacacgtgatgcgggggagggcggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacggtgcggatggtggtggcctgcgaggctcatttctagcaaggaacaaggctttcccgctttgattttataaatattatgtttacaaagctgtaatatatagaaattgataagacgtgtccctgtccctggaaacgcaggcaccgcgtgtttggaaagacattcatctgggctgtttgacagactccccagttggtgccatgctctgtgcttagggaactgtgagacccctggaggggtgggtaccgggaccgcactcagcctggggtttggaggcggcctcctataggaagcgacctgggacctaagatttttagactgactgtgggttcactggaataaaaaggaagaaacaaagagcattgcaggcatcgggactgtcacatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgta

SEQ ID NO: 366822 - DNA, 340 bp, Homo sapiens
ctataaaatatgtatcagttggggttggagagaggaactgtgatcaaagtagtcacccggcccatatgagaaaatgaaccttttcccaaaaggtggccccagactaaaaagcctggagaatcctaatagtggattataccatctcttcagtcttcgtgtttaagaaataacctctttggcttacagatttgacaagatcaaagctgcaggaaaatggacagtgaggttcagagagatggaaggatcttggatttgattgatgatgcttggcgagaagacaagctgccttatgaggatgtcgcaataccactggtaggttatgatttgagctgaggatggg

SEQ ID NO: 366823 - DNA, 1459 bp, Homo sapiens
agtgcagacacgtgatgcgggggagggcggggcgtggcaggagcaagcgtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgcttccacgtttggtacatcctgcctgaggcaggaagccgcagctgagggacggcctgtcgtacgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatcctttt

SEQ ID NO: 366824 - DNA, 1679 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttttatgctgggtctttttgtttacttagcttttaggaggaagaggtacatgaaaaaacaaattagcttattttaggttttcaatcacaaacatgattttagcagctatcctataatccagatacatccaggctgatttcttctctttgcatcagtagttctgcctagaaatcttttatcttcagaataaagaccccaaggcaccagtcccttcagtaagcaaagaaagacaacctaatagaaaagagacttacaatattaaaaaaacttatacaagagaaaaagcttttcaaaaaattaaaatacctagaacgccacagttctttcacattcttgttaaatgaggattttacagcttacttgtggtatgtaatctctgagacactaacatctaagaacttgacaaatgttcatgtgaatcctgcctagcctttccctggaatattagtagaccagtaaaatatgaaagctat

SEQ ID NO: 366825 - DNA, 1378 bp, Homo sapiens
agtgcagacacgtgatgcgggggagggcggggcgtggcaggagcaagcgtctgccgcggtggccgggtgccgatttgacaagatcaaagctgcaggaaaatggacagtgaggttcagagagatggaaggatcttggatttgattgatgatgcttggcgagaagacaagctgccttatgaggatgtcgcaataccactgaatgagcttcctgaacctgaacaagacaatggtggcaccacagaatctgtcaaagaacaagaaatgaagtggacagacttagccttacagtacctccatgagaatgttccccccattggaaactgacgcttggctcctttcttgtggatggattttctcaaagtacacagataaagcatggtttgtttcagtctccaaattcaaacctttgagtaataaatcagcactcaaaaatgtacacccatttagtttgtggtagcaaagtgcaatgcgaaattgaatgagaaactgagatttctcagtaatggtgaatatttcgctctttaaacctaaaactcttcattgagtagcttatatttgaacatgattggttaaacatttgcctctacctctgattttgctttgctgtcaaagtttaacaccttccaactacttatgtgtgtcctgtaacacaggtgattgaacgtatgagagggaaaggcaaagaaaaaggaagccagacactaggagaattattaacttctcatacttccccacattgagaagcattcggagtgtatttagcctgtagatgttgtgatatgcaaatatcccattccctggttactggcattcctaagattcttcatggtattttcaaactttggataaatttacagattagaaagatatctgacagttaatctctgttctccttacaaattccttttgtgctgctggaaaggatctttggctaggtggatgactagttttattcaaagccttttctcaaagccctttcagttacaaccaccccactatggaatcagtatttagttatacatttgtataagaacctgtattttgaaaaacacattcatgtatatttattcctggaattatttgcctgttaaacagtgtctttcatgttctctccccagattgtaaactctgtaagaagctgcttgtatctgtatcccttgttgaaactctgaaaacactgaataactaaaatctcttctcatccttttaaaaaaaaaaaaaaacaaaaaaaaaaaagggggggggttaaaaatcctggggggcaattttagtttccgttttgtacaagggggcttaggaaggtttaaaaaaacgggggttaaaatggtcaggaaaagggttgggtttgggacccttttgggttaatgaactcaagatt

SEQ ID NO: 366826 - DNA, 453 bp, Homo sapiens
tggtagagatagtatttcattatgttaccctagctggtctcaaattaccctcactcttgactgaaagtttactagaaacaattaataattaacagcgcattgaagacctatttcttctggcatctactgctgctgatgagaagtctgctgtcagcctaatttgtgagtaatatttcctttctcgctggtagcttttcaaatttccccttttaggattattcttaaagttctgcagtttctctaagctgtcttttctcggccctttttttaatagggagagccccactcagcttttcgtgctcatttagtgctcattttaccctgaagagcccatctttctgcctacttctgggcagagtggccagaaggcccaagtcttctgcttcttcccacttctttgtgtttctattccacttctgtttgggagatgtttattgccttggtttcttgttt

SEQ ID NO: 366827 - DNA, 408 bp, Homo sapiens
tggtagagatagtatttcattatgttaccctagctggtctcaaattaccctcactcttgactgaaagtttactagaaacaattaataattaacagcgcattgaagacctatttcttctggcatctactgctgctgatgagaagtctgctgtcagcctaatttgtgagtaatatttcctttctcgctggtagcttttcaaatttccccttttaggattattcttaaagttctgcagtttctctaagctgtcttttctcggccctttttttaatagggagagccccactcagcttttcgtgctcatttagtgctcattttaccctgaagagcccatctttctgcctacttctgggcagagtggccagaaggcccaagtcttctgcttctttccgtcgacgcggcccgcga

SEQ ID NO: 366828 - DNA, 1160 bp, Homo sapiens
aagacaaaaacaacaaaaaaaaagaaaaataggcaagagaggcctgggtgagtcggagaggtttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagagcgcgtggaaactgacaacaaagtacaaaaacaagacgcgtaaaagaagaaaaaagaaaaacgaacgagggggaaacacacagcaacgtgtgcacaatcagaaagagcggatgagagcaagaacatacaaggagagaagcgacagcgcagcgcacaacgccaggaagcaagggcacccgagaaacaaacgcgaaaacccagaggagaagacaaaacgagagcagacaagaacagaacagacacccaccaaagacagcagaacaaaagcaccgagaaaacacgcacagaacgaagacgcaacacaacaacaacacacacaacagcaaggaagaaacaaaccaaacaagaacggaaggcacagcgcacgaaaacaaaagaccgaacacaagaacaacgagacaacaaaaaacaaaagagaatcagcaacacgaacgtacaagcaggaaaacgaagagcaaatgaacaccaccaccgcactaacaaagaggacagagagcaaagcggaaggcacagaccatagacagcgagagcacacacagaacgacaacagcaggcaggaagagacacaacaccaagcgaaggcagagcaagagacgcacgacaagcaaagagaacaagacggaagacatgaacaagcgacaacgctagaggacaccaacacaaagacagaagggagaagaacaacaagggacgacgccacaacgacaaaaacgagaaggcggaggagcaagacaaaaaaagcaagggaacacagcagagagaggacacagagcagaaagcagcacgcgatgaat

SEQ ID NO: 366829 - DNA, 2465 bp, Homo sapiens
tctccgccccccagtacctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaagaaatcaaaaatccattcttttctccttctctccctccaacagtggccaggggaaggggaagtgagggcaggggcaaaaagatttgggaatttttatttatttatttattgtgacttttcatttttttggtatttggctttactggaataggagggcccctgcccactgtgccccgtttatcccttattccccaaaccctgctctccccaacacctactcacttaagcacttgtataaagcctccagggttgggaatgggagtaaagggcaagagggcggacacatgaagtttagtttctaacccatcatcaccctaactcaaccttttctgagccaaatggcttgaattgaagccagttgtcatggaaatagtaagaggttagggtttaagagctggggatgcgggggtgggagagagaaccctcaacatccaggatctatataatgagagctactttaaaccctcaggtccaccctcatgatgctgagttatttagccagagggtgcagcctgcttatgcccaaattccctcagccaagagagagaccaaagagcctctggaatggctggatggtagagtagtcagaacacacaccatacttattaagttcgttgtcttatacgggcacgtttgtggtgccccaaaacatgtaccatatttcacatccaaggtaacagctcgcatatctccctgccatatgactaatatgcccctatcgatgg

SEQ ID NO: 366830 - DNA, 2208 bp, Homo sapiens
ggggaggttaaattttggggggattccaataatcagaaataagtggcattgccagaggccctcatataagagaacagcaaaaaagttatcctcccttaagttcctccctcactcctcatatcagacacagcaagagaactcagctcaacaccaagaagtcctgcccttattcacaccttccttcctatagccctcatcctcacagaagcttctagcctctatcttcagcagttcttaagaggtggggtggggggctgggcagtttagagtgagagtggaaaaaaagaataatcctagagaaccataaaaaagtacagatttacagctgaggaagctagttctccccacagcttttatagactccctcattaagagcttccaggtatgcagagaatgtcacagcttcaggaattggaatcagttaaccacatctggatgctggatcaactatagtagggaaacggggagaggaaggaagggtactaagatctcaggtaaacaattacaagcctcaatgtctgttccatctccaaacggaattactattttaaaactgaattgggaaaaaggcatcctgaactattcatgctcaaagagtatgtggagaatgactataatgagataggaaggggaggacttcatctggcttggaggttagagacttctgaccaacataggaacagctgctgaaatgggatgaaagaggttaataagaaaaaaaaaaaatcctcacaaattggaaaacactgttcaaagatctaggggaagtaagatgagtgaggagaataattaggcttcaagaagagaatcctggcaagtaaggctgaatatctttctggaaggttatagaggataaagagacgaagaaaacttccaaaagatccactgttccacttcataatcagcatctgctctattccctcatgtatttttctctttttaaaaccatattcaggaagaaaccattagtgaatctataatctctcaagttacaaatcagatctattctgttttcagatgaaggcagagtagagagaggaaaagctagccccaagatcagagcctgaggtaaagaaaaggaaggcagacagaaaagagggaaaagggaaggtcattccaattttaaggtttatttggttgaagaggtgtcaaaaatttaaccagcattcccttttgttcacttctccaaagtctcagaatggggcaaacttcacaacaaatgggcagcagtttttggatctgctctccaaggcacaatttttctaaattatctaaactttaggtccctgctttcctcaccaaccagagactttggagaaataaagagatatcttgacattagaaaggtgatcaaactattaccatttcattaagcacaaaaccaggcaggttttagtagaaataaggataaaggattacaccacagcaacatgggacctgatcatagtaccaaagtcttcaggtaaggtgtcaggctcctaagtcttattaccaaaaatagctcaaacaaaaaccgagcttatataaagattaagaggagaaattctgcaataacatatccaaaaagattaagcaggtttcagatctacatgaacttgaagcctccagttccactgcttatgttcccaatgatttagctaacaatgcgtaacagctctgacatcctctgtcatgctttgattctgcatacaaaatttcttctgtctctgagggatatccagcccatctcccttcctgaactgactgaccaacatagtatcgtatcacatcacccttgaaatcagggcccttttcctttaatgtgggaccctggactccattttatccaagaaaaagtctgcattattagctaataacagaaggctactaatcactgcccttgtatttatatcctttgcaacacctaaaacctcccatgttctgttttatttcagtgggtcactacaagctgctggagcaaagacttggtgggtgggtaacttaacctcttcacagaggataaaaaatgcttgtgagtatgacagaagggaataaacaggcttaaagggtaaactcagtccttttccttgtcttctcttctaagggataaaggtattatggccaattctctataatatttgcccctgaagctccccttatctggtctaatctagctccaataaatcaaaggagcacctaataaaacacattgttctcttttaaattttt

SEQ ID NO: 366831 - DNA, 1537 bp, Homo sapiens
tctccgccccccagtacctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaagtgggtcactacaagctgctggagcaaagacttggtgggtgggtaacttaacctcttcacagaggataaaaaatgcttgtgagtatgacagaagggaataaacaggcttaaagggtaaactcagtccttttccttgtcttctcttctaagggataaaggtattatggccaattctctataatatttgcccctgaagctccccttatctggtctaatctagctccaataaatcaaaggagcacctaataaaacacattgttctcttttaaattttt

SEQ ID NO: 366832 - DNA, 2772 bp, Homo sapiens
tctccgccccccagtacctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaagaaatcaaaaatccattcttttctccttctctccctccaacagtggccaggggaaggggaagtgagggcaggggcaaaaagatttgggaatttttatttatttatttattgtgacttttcatttttttggtatttggctttactggaataggagggcccctgcccactgtgccccgtttatcccttattccccaaaccctgctctccccaacacctactcacttaagcacttgtataaagcctccagggttgggaatgggagtaaagggcaagagggcggacacatgaagtttagtttctaacccatcatcaccctaactcaaccttttctgagccaaatggcttgaattgaagccagttgtcatggaaatagtaagaggttagggtttaagagctggggatgcgggggtgggagagagaaccctcaacatccaggatctatataatgagagctactttaaaccctcaggtccaccctcatgatgctgagttatttagccagagggtgcagcctgcttatgcccaaattccctcagccaagagagagaccaaagagcctctggaatggccctgctcccagcctctatcttcaggtcaattagagagagtatagagaccccagagtcccctgggtctggaaagcgttaggagaggtcaagaaaggagcagtaaggaggctgaaggttacagggcatttgaatccaaatcactgctctgggctagggaatagagccagcagaccaaggtgggaaggattctggaagggggacattttagtctcctaaccccaaagctcagggtggaagaggggagaacaaggaagcagagtgtataattattttttccttttatttttggaatctaacagtacctggcagcagggaggggaaagtacagtggggaaaagcatctgacaaggccagttagaacagaggatgggaaggatggagactcccgggcttggaaggctaggaagcaggcagagactggttgccatttcaagtcactagctaggcccattcattcctccca

SEQ ID NO: 366833 - DNA, 1774 bp, Homo sapiens
  misc_feature (1761)..(1761): n is a, c, g, or t
tctccgccccccagtacctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaacatttgtaaataaagttaaanttctaagtcaaaa

SEQ ID NO: 366834 - DNA, 877 bp, Homo sapiens
ggtagtggttggctgtgggaccccggcacccggctccgcacctgaggggaaatccgctggaaagcactagggccaagcggctccggtaggcgcgcggcagagaggtggtccgccgccggcagccggggctttggtggccgctgaaggtttgcggcaggaggcctttgtgaagtcagtcggctccaggtcgccctccggatgcggtccccacaccgcctgcgtcacctgggttgaggggctcatttgaaatacagacttcgctacccaccccagcctgctgaatcggaaatgcagcggtgagccataggtgattattatgcacccttaaatttaagaattagtcattcggaggtttctctcaatggcgaacttgaaaataagttcaggaaaccagacaattggagcggaccgacagccctgattccaatggtaagagcagtgcgctgggtgtgatctttctgccagcaccttaaggcctcacttaacctcgggaccttagttgcatcatctatagaatgaaatgattgctctccgacctaccttctcgtggtggtgatgtgataataaaaattgaatagtgagcaacccagtgggctatggaaatgtgtggaagatggcatttctatttctcagtggggctcttacctattactcatcaaccttgtaggcagaattgactgatgcagcctacacagtatttaattacataaatgggacaccacctatgtgcccaacatgggatttgataggaaggatttgaaggggttagagacagggagaccaaataggagtctgcccagccacccagctttcgggtaatgtgcgtctggtcttcagggccaacaatagagagaatgtgaaattaagttgatgatgg

SEQ ID NO: 366835 - DNA, 717 bp, Homo sapiens
ggtagtggttggctgtgggaccccggcacccggctccgcacctgaggggaaatccgctggaaagcactagggccaagcggctccggtaggcgcgcggcagagaggtggtccgccgccggcagccggggctttggtggccgctgaaggtttgcggcaggaggcctttgtgaagtcagtcggctccaggtcgccctccggatgcggtccccacaccgcctgcgtcacctgggttgaggggctcatttgaaatacagacttcgctacccaccccagcctgctgaatcggaaatgcagcgggtagctgtcaatggctttggaagaaaatcccagagataacagaacattcttgctgcattatggaattaaatgatcttcttggcacagaggacaatgctatgggatgaatgagttggggaaatgaatgcctatgatgctgattttaaaaattattcaaaagagctggattctaaaagttgaatgaatactttatataacttatattttcctttttatacttgcacaagagtaaaatagaataaaaatcatttctaaataaagcttaagagttcttttatcataaaaatctgggcttaaaagagctctttcaataagcgttaaataaaaattttaggattctgttgtaatttaattggttatttatttaattattccctccttgtcagttgatcttagagctgactaaatacagtttgtctc

SEQ ID NO: 366836 - DNA, 850 bp, Homo sapiens
ggtagtggttggctgtgggaccccggcacccggctccgcacctgaggggaaatccgctggaaagcactagggccaagcggctccggtaggcgcgcggcagagaggtggtccgccgccggcagccggggctttggtggccgctgaaggtttgcggcaggaggcctttgtgaagtcagtcggctccaggtcgccctccggatgcggtccccacaccgcctgcgtcacctgggttgaggggctcatttgaaatacagacttcgctacccaccccagcctgctgaatcggaaatgcagcggtgagccataggtgattattatgcacccttaaatttaagaattagtcattcggaggtttctctcaatggcgaacttgaaaataagttcaggaaaccagacaattggagcggaccgacagccctgattccaatgggtagctgtcaatggctttggaagaaaatcccagagataacagaacattcttgctgcattatggaattaaatgatcttcttggcacagaggacaatgctatgggatgaatgagttggggaaatgaatgcctatgatgctgattttaaaaattattcaaaagagctggattctaaaagttgaatgaatactttatataacttatattttcctttttatacttgcacaagagtaaaatagaataaaaatcatttctaaataaagcttaagagttcttttatcataaaaatctgggcttaaaagagctctttcaataagcgttaaataaaaattttaggattctgttgtaatttaattggttatttatttaattattccctccttgtcagttgatcttagagctgactaaatacagtttgtctc

SEQ ID NO: 366837 - DNA, 783 bp, Homo sapiens
tgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 366838 - DNA, 1154 bp, Homo sapiens
tgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaaatactcagcactataatgtaagacacagcacaacatacacaaaaaaagaggcgggcggcctatagattctcccccgggggggcacacacagtgcggctccacaaatttgtgacaacacgaggccccacatgagggcgtcttataaaaacagacgccgagcgcccggttaacccagcgcccgagcggacgaaaaagcgcgacaccgcgaccctcgtggcaagacacacacttgggcggggggacaacactgcggaccacacaccccagagagatgacacgcccgcgggacagacacgaacgacggggtcacagtgtgcacacaggccatatgacggtgcagaagattgcgcagggatcggcgaacacacacg

SEQ ID NO: 366839 - DNA, 725 bp, Homo sapiens
gagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatga

SEQ ID NO: 366840 - DNA, 409 bp, Homo sapiens
agtactgacagtctgctgcacagccaaacatggtgccaaagcaggtaagggttaatctcaatcaccttgttcacccgtaaggcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgcccagcacccagagatctgtccgc

SEQ ID NO: 366841 - DNA, 1114 bp, Homo sapiens
gagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtgtttcagagtgctggccacaccaaagcatcagccctggctctaaactccgttacagtaaggaattacaaatcctgtgtttgtactccaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatga

SEQ ID NO: 366842 - DNA, 171 bp, Homo sapiens
tcatccgggatgcctgatgttgtaaagtgtcagtcatacctagaacacggatcccgctgccggtgtggaccatcgagtcatcttgggcaatgaactgccaaaattctatgatgagtgaaccttccccagacttctctttcttattttgtaataaactctctagggccaaaa

SEQ ID NO: 366843 - DNA, 1105 bp, Homo sapiens
tgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctatggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagaca

SEQ ID NO: 366844 - DNA, 1121 bp, Homo sapiens
gagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtgaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 366845 - DNA, 809 bp, Homo sapiens
ggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtggtgagttgtgaggcgcgcccagtccctctgttcccgcctggcacttgctctggccgcgcccgccccat

SEQ ID NO: 366846 - DNA, 809 bp, Homo sapiens
tgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaaaaaaaagtcgaacaccacaaaagggg

SEQ ID NO: 366847 - DNA, 1142 bp, Homo sapiens
gagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctatggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagaca

SEQ ID NO: 366848 - DNA, 719 bp, Homo sapiens
tgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctacttctactaaaagaagagtatgtggatactttctaagaactcaaaaacgagaaaaccaaaatcagagggtgcatgaatatatgtgcacaggtgagaggtcactatcctcctctccactgctttcttgttcctgaacctgatactttggctccaagccttcagcagcagctaagttcttagcaagctatctgttgccatagcttcagtggtttctgtatcactacatgcatcttcatcatcacccat

SEQ ID NO: 366849 - DNA, 496 bp, Homo sapiens
cggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacacgttagcgccgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccggggacttaccccgggcgggagaagtccacaccggggtaatgggtctgggcttgagggttggcagaggggtggaggagatgc

SEQ ID NO: 366850 - DNA, 752 bp, Homo sapiens
tgtgtgtggacaagggcaggaaagttctcttgtcttcctttgggagcccccacctcacctgtaactctttgtcctaacttgcacttcctcctctcaggccccatccccatgtggcctcttctttgggtctggcgctctccgggactgaaggctacccccgaccctgtaccccgcgctcccgctctcgcctcctcctctcaggcgaccctccactcctcagcgcccgcctccctgcatccctaggggcttccctactgccccgacctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgcccagcacccagagatctgtccgctctcggaggaggaagtgaaagcgaaagccacagatcgaaggggagggaacaagactcttttccacatccccctgccttttccgagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcg

SEQ ID NO: 366851 - DNA, 1055 bp, Homo sapiens
  misc_feature (1)..(2): n is a, c, g, or t
  misc_feature (5)..(5): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366852 - DNA, 744 bp, Homo sapiens
cctcaggagttggatccaggctccaccctctcagcaattatcttaccatggataataaagcttagcatgaaacctcccgcctaagctgtgtcgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366853 - DNA, 1195 bp, Homo sapiens
  misc_feature (1)..(2): n is a, c, g, or t
  misc_feature (5)..(5): n is a, c, g, or t
nnccnctccaactctcaacccacttctccagccagcgccccagccctcccgccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366854 - DNA, 897 bp, Homo sapiens
gaggaactccccacctccagccgcagcagcactctctgccagcctccctctgaacaggacaccgagccagttatgtcttcttacttagcgatgtgattctctggccttctcagtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366855 - DNA, 668 bp, Homo sapiens
gcttcagtgtctgctgcctatgacatcctcttcgcagagcactgggcgtcttttacaatcagctataccaccctataccaccctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366856 - DNA, 1269 bp, Homo sapiens
  misc_feature (1)..(2): n is a, c, g, or t
  misc_feature (5)..(5): n is a, c, g, or t
  misc_feature (1063)..(1063): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagaaaaaaanaacaacagaaaactacgatacaaaaatgtgtttgggcgcgccctgcgcccctaagaaaggtttttgtaaacccatcttgtgggggcccggggcccccgtgggtagtgagacagtggaaaacggtgtcctccaaggaaacccgtggccggacaaggggcggggttcccccaaataaaaccgcggggacacgagctttggcaaaatcg

SEQ ID NO: 366857 - DNA, 1027 bp, Homo sapiens
  misc_feature (1)..(2): n is a, c, g, or t
  misc_feature (5)..(5): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtgccattccttacaccccttccccatcctgctccgcttcatgtcccctcctgagtagtcatgtgataataaactctcatgttattgttcccag

SEQ ID NO: 366858 - DNA, 1222 bp, Homo sapiens
  misc_feature (1)..(2): n is a, c, g, or t
  misc_feature (5)..(5): n is a, c, g, or t
  misc_feature (1016)..(1016): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgagggccacagccctgctccagcagcacttgcccattccttacaccccttccccatcctgctccgcttcatgtcccctcctgagtagtcatgtgataataaactctcatgttattgttcccagaaaaaaanaacaacagaaaactacgatacaaaaatgtgtttgggcgcgccctgcgcccctaagaaaggtttttgtaaacccatcttgtgggggcccggggcccccgtgggtagtgagacagtggaaaacggtgtcctccaaggaaacccgtggccggacaaggggcggggttcccccaaataaaaccgcggggacacgagctttggcaaaatcg

SEQ ID NO: 366859 - DNA, 1457 bp, Homo sapiens
  misc_feature (1)..(2): n is a, c, g, or t
  misc_feature (5)..(5): n is a, c, g, or t
  misc_feature (1457)..(1457): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagaaaaaaaaaaaaaaaaaaaaaaaaaaaaaaaggggggggggttttaaaatttcccccaggggggcccacacatgttctaaacgccgttacccagctcttctgtgtgtacaacagcggtggtccccctaatattgagacgcgtcgaatattatataccgtaacggacacgtgagccgctactatcttacaacatgcttgatgtcatgtgggaaaacagcgggcaccagtgggggaaaacatggtgggagagaggaaaacctttaattcttgagggcgggtgaaacaatattggggcacaaaactaacctatacagaaaatttaaagagcctccctcaaggcgacaacatctatacagcattatgcacacgcggtattacacggggtgctacacacattaacctggccacacactgcgctccccccgcctcgtacaacacatttcggcgccaaacggacgacttcgacatcttgccgaaaccactttctccacccgggccctccacaaataccgn

SEQ ID NO: 366860 - DNA, 313 bp, Homo sapiens
gctccagagctaagctgcccctggaggagagactccgccctttctctcccactcacgattgtcttgcctttcctcttccattagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcct

SEQ ID NO: 366861 - DNA, 855 bp, Homo sapiens
cctcaggagttggatccaggctccaccctctcagcaattatcttaccatggataataaagcttagcatgaaacctcccgcctaagctgtgtcgctggggaagggcctgcatggaggctctctcgtgggagaggagttgcatttcctgtactaagcctgctcctggctcaatctctccccaggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366862 - DNA, 748 bp, Homo sapiens
tgcatcaacgcgttgggagctctccatattgtcgacctgcaggcggcgcgaattcactagtgattagctgtgaggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366863 - DNA, 1568 bp, Homo sapiens
  misc_feature (1)..(2): n is a, c, g, or t
  misc_feature (5)..(5): n is a, c, g, or t
  misc_feature (1568)..(1568): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagaaaaaaaaaaaaaaaaaaaaaaaaaaaaaaaggggggggggttttaaaatttcccccaggggggcccacacatgttctaaacgccgttacccagctcttctgtgtgtacaacagcggtggtccccctaatattgagacgcgtcgaatattatataccgtaacggacacgtgagccgctactatcttacaacatgcttgatgtcatgtgggaaaacagcgggcaccagtgggggaaaacatggtgggagagaggaaaacctttaattcttgagggcgggtgaaacaatattggggcacaaaactaacctatacagaaaatttaaagagcctccctcaaggcgacaacatctatacagcattatgcacacgcggtattacacggggtgctacacacattaacctggccacacactgcgctccccccgcctcgtacaacacatttcggcgccaaacggacgacttcgacatcttgccgaaaccactttctccacccgggccctccacaaataccgn

SEQ ID NO: 366864 - DNA, 1298 bp, Homo sapiens
  misc_feature (1)..(2): n is a, c, g, or t
  misc_feature (5)..(5): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctggcccctctgtggctgtactgctggagaatgttcccaaccaaaggggtccctaaggtgtgtgcctgtgtatttggggcagtggaactgctcaaaggagacaggaatggacagtggacagtttggggaggagaaaggggcccatgacccaagtcccacctattatcatgcctgtctttctacccagtggtggcccagcccagaaagcccctatccccaaccaagtggcccccaagtcaaagagcccaggaatccagggaagtccatatccatgctatgcctttggatcagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366865 - DNA, 944 bp, Homo sapiens
  misc_feature (1)..(2): n is a, c, g, or t
  misc_feature (5)..(5): n is a, c, g, or t
nnccnctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctagcgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccag

SEQ ID NO: 366866 - DNA, 877 bp, Homo sapiens
ttcccctcgtgaggggccaggggtgcggccctgtgaccaggacagccattcattgggtgactttgagccaccactggcccctgacctccccaactccaatgaaatctgcgaaaatcttctgacagccgttcctctctggtgctcccttcctcatagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgagtgtgacggcctgcctcgtcgggcggcgggaggaactccccacctccagccgcagcagcactctctgccagcctccctctgaacaggacaccgagccagttatgtcttcttacttagcgatgtgattctctggccttctcagtaagagcctggggaggggaggctctgggctgaaggggtgtggaggagccactgaccatgcagagtcccaatcagtggagccctgagtccatcctttcctctgggccaaactcaggatgggccggctctcctctccttcctttcccttctcttttctcctcctcctgcctcttcttctttctccttctcctcctctttcttctccttttctcttctcttctcttctcttctcttctttctttctctctctctctacctctccctctctttttggggttttagcggttaatccctgcagtggcaggtccacctaggagccgggatcttgggtcctttgtctttcaggtgatgcagatcgtgctggggatcttgagtgcagtcctagga

SEQ ID NO: 366867 - DNA, 289 bp, Homo sapiens
taaaatagttatgtcatgaatgcataaaatatatgtagatattagtctatttatgtgttaacctacttcgttatcagtaagactcctggtccactgtaggctactacttttggggagtcaaaagccatgtgtgggattttccactgtgtggcatcacccccctgtgttgctcttcaagggtcacctgtttggccacatttaaacatgggcccaaacttttcagatttaaagttaacagactgatgttagttaagctcagagggaaggcttttcaatgaagtgagtttaa

SEQ ID NO: 366868 - DNA, 832 bp, Homo sapiens
tccaaaaactgccctgtggagagggggctgggggacactcgtgacacctgtcgggcggcacatgtgatgggtggagcacccaggttctccaagcagcaggaggctctgatggacccccctcccctggcggggggacgctactgctagaagcagcgaagggcccggtgccccaggtttcagctgcctgccttctgccgtaagttgccccagcaccttcgtgcttttcaggagcgtaagctgagcagactcagtcgtcccagtggtcagtgtggctggggcagagggacacacggtccacaagacgtccatgctctcggaatgctccaggggtttggctgtggggctccaccaccattgcctgagcccggagccagaggctcctcccacactgcctggtctgccccacagagcatcagtgccacgccaggtgaggacagcgctcaccagacaaccaggcctgccgccccactgacgctgacttccggacctgcagaactgtgagaaagtacgtttcgcttctttgtaaactgcctggtcagtggtggcagcacagatggaccgacgtggacctcgacgcgaatggcgggctctgggcgctgacccggtggcggcgtagctcaccgaacacccagggggaccagaactctctgccttccactcagttgtgacttgtctatttttaaaatgttaaaaaaaaaaaaaacccacaaggtgcagtggctcacacctgtaatcccagcctttgggaggttgaggcgggtggatcgctcaagctcaggagttcgagaccaacctggcccacatggtgaaaccctgtctctaataaaaatac

SEQ ID NO: 366869 - DNA, 422 bp, Homo sapiens
cacctaacataaaattcactattctaaagcgcacacttcagtggtttttagaaaattccctatgttgtgtaaccatcaccattactctcaaaacatttccatcaactgcgcccccccaccgaaaaaaaccatactattagcagttagtcccaatttcccccttctcccatcccttagcaactactaatctgtctatggatttgcttattctggatattttatatactgtaaattgaattattagcataatattttcaaagttcattcatattgtagcatgcatcagtacttcattccttttatggctgaataataatccattgtatggatgtattacattttgtttatcctttagttagctgatggacatttggattgttttcactttttggccattatgaataaagctgctatgaacattc

SEQ ID NO: 366870 - DNA, 2418 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366871 - DNA, 2475 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagcacagctaactttggagacctaccaagaatggtgcaatgattcagcagctactcatgaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366872 - DNA, 2606 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagcacagctaactttggagacctaccaagaatggtgcaatgattcagcagctactcatgagatgggagatggtgaacaggcgtgtggagggcggaataatggtccccaaagatgtccacgccctcatcctcagagtccgtgaacctgggaatgtgctgcctgacgtacaaaagggactccgcagatgtgaaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366873 - DNA, 2285 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagcaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366874 - DNA, 2356 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366875 - DNA, 1348 bp, Homo sapiens
gtgagccaccccatccagcccaaaatgttaaaggagaaaaagattatcctagaaattgggatttactgaagtctagttactacaatgggcactctgagacctcacagccagaaacacagttctaaagctatcagcctctttggccacacaacacaccaattttcacacataaaatgtgtccactgccagccagtgacccactaaaaatggcatcttgttcttctttggttgtcgtgttcacagtgaatttgaggaaacatcagaaaagatgtaggcagcttggccatgttcatttacatgtgtgcttgtgatgtttttaaaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366876 - DNA, 2590 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaccgtggaaattataacagatctgtttggtgacacaaacgcacaaaaaaccccggggccgttacctccctctgatggtgccccattttaaaatcgcaacgggccattcccctagggctttccggaacgaaaaaatttctgggctattattcacacttgcccagaggcccccacgttgttttgccccctaggggggtcacttaaacccctttggttggcgcctaaaact

SEQ ID NO: 366877 - DNA, 4033 bp, Homo sapiens
  misc_feature (1887)..(1887): n is a, c, g, or t
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatggctgtaggcaacaagattgttggcaacnaagaattgaagaatcatctgtaaccccagctactcgggaggctgaggcacgagaaccatttgaacctgggagacagaggttgcagtgagctgagattgcaccactacactccagcctgggtgacaagagcaaaactccatctgtggtcccagctgcttggaaaccggaggtaagaggattgcctgagctccagcatttgaaggtgcagtgagctgtggttgcaccactgcactccagcctaggcaacagagtgagatattgtctttaaaaaaaaaaaaaaaaattcatggcagagtcagaaatagaaaaaaacagccaccatttccagtcagtcttcagggaaaccttcaataaccctcacataagcattttacaagtctatttcttcttattttataaacataactgcatctttaattgggtgtacttgaataattgaaaactgaacagcaaatcaatttttatggttcattttctccaacaaacaacaatattaaactgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatacaaacagtgcaaatacagtactgcaaactcagtaaaaggagtttttgattggagtatgaactttcaagttgaagatatatttcacaggaatattcacccaaagcttgagagctagagcgaggagagacttgcagtcggtaactgagtagatgaaatgcataatttttcactaggtgataattccctttgggaagaagtgctttatctttaattattccactttttgttaaatggttcatgcttttaaactgcgattgtctcaaacttgcttgctattgaattgtgtaacatcagataatggcaagttgtcaaaagataaccccagtggataattgaagctgcttttacgagaagcatggtgctgagctgccttacacagtctttttacagtaaccataaaaaactgagtttatttgatcatgtattatcccttctcacataaagtcatattagaggaattctttttaaaagaagctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattccagatatatgaagctatatttttttgtacatcttcagaaatcagagatactgagagtggtcttcttttttttgagagggagtttcactttctcccccaggctagagtgcagtggcgcaaactcagctcactgcaacctctgccccccgggttcaagcgattctcctgcctcagcctcctaggtagttgggattacaggcacccaccaccatgcctggctaatttttgtatttttagtagatggggtttcgccatgttggccaggctggtctcaaacacttgacctcaagcaatcggcccgcctcggcctcccaaagtgctgggattacaggcatgagccaccgtgcccagccagagagacaagagtggttacttctaaaatgacaagatgatgtaaccctggctcagggagtagatcaagttctaaatctcaggaataaaaaactgatactcattatccaattcatatagtcttgtattatatacatattaacagtctatgcaatgaaaaataaagaaatttcataaaactatttcaaaactcagaacataaaaatgtaaagaaacaaaacatttaatgtacaatctactccatttggcaatgtgtactgagagataaaaaacctatctacaaacagaatata

SEQ ID NO: 366878 - DNA, 1170 bp, Homo sapiens
  misc_feature (6)..(6): n is a, c, g, or t
  misc_feature (12)..(12): n is a, c, g, or t
  misc_feature (31)..(32): n is a, c, g, or t
  misc_feature (34)..(35): n is a, c, g, or t
  misc_feature (37)..(38): n is a, c, g, or t
  misc_feature (40)..(40): n is a, c, g, or t
  misc_feature (49)..(49): n is a, c, g, or t
  misc_feature (52)..(52): n is a, c, g, or t
  misc_feature (55)..(57): n is a, c, g, or t
  misc_feature (59)..(61): n is a, c, g, or t
  misc_feature (63)..(65): n is a, c, g, or t
  misc_feature (68)..(68): n is a, c, g, or t
  misc_feature (73)..(73): n is a, c, g, or t
  misc_feature (82)..(83): n is a, c, g, or t
  misc_feature (91)..(91): n is a, c, g, or t
  misc_feature (96)..(96): n is a, c, g, or t
  misc_feature (98)..(98): n is a, c, g, or t
  misc_feature (101)..(102): n is a, c, g, or t
  misc_feature (104)..(105): n is a, c, g, or t
  misc_feature (108)..(108): n is a, c, g, or t
  misc_feature (113)..(116): n is a, c, g, or t
  misc_feature (119)..(120): n is a, c, g, or t
  misc_feature (122)..(122): n is a, c, g, or t
  misc_feature (124)..(124): n is a, c, g, or t
  misc_feature (126)..(130): n is a, c, g, or t
  misc_feature (132)..(132): n is a, c, g, or t
  misc_feature (134)..(134): n is a, c, g, or t
  misc_feature (137)..(137): n is a, c, g, or t
  misc_feature (146)..(146): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (161)..(162): n is a, c, g, or t
  misc_feature (164)..(164): n is a, c, g, or t
  misc_feature (168)..(170): n is a, c, g, or t
  misc_feature (172)..(172): n is a, c, g, or t
  misc_feature (175)..(175): n is a, c, g, or t
  misc_feature (177)..(180): n is a, c, g, or t
  misc_feature (182)..(184): n is a, c, g, or t
  misc_feature (189)..(189): n is a, c, g, or t
  misc_feature (193)..(193): n is a, c, g, or t
  misc_feature (196)..(196): n is a, c, g, or t
  misc_feature (198)..(199): n is a, c, g, or t
  misc_feature (202)..(202): n is a, c, g, or t
  misc_feature (205)..(205): n is a, c, g, or t
  misc_feature (211)..(212): n is a, c, g, or t
  misc_feature (216)..(217): n is a, c, g, or t
  misc_feature (221)..(223): n is a, c, g, or t
  misc_feature (225)..(225): n is a, c, g, or t
  misc_feature (230)..(230): n is a, c, g, or t
  misc_feature (233)..(233): n is a, c, g, or t
  misc_feature (235)..(235): n is a, c, g, or t
  misc_feature (237)..(237): n is a, c, g, or t
  misc_feature (240)..(241): n is a, c, g, or t
  misc_feature (244)..(245): n is a, c, g, or t
  misc_feature (248)..(250): n is a, c, g, or t
  misc_feature (253)..(253): n is a, c, g, or t
  misc_feature (256)..(256): n is a, c, g, or t
  misc_feature (261)..(261): n is a, c, g, or t
  misc_feature (263)..(264): n is a, c, g, or t
  misc_feature (266)..(266): n is a, c, g, or t
  misc_feature (271)..(271): n is a, c, g, or t
  misc_feature (275)..(275): n is a, c, g, or t
  misc_feature (279)..(279): n is a, c, g, or t
  misc_feature (281)..(281): n is a, c, g, or t
  misc_feature (284)..(284): n is a, c, g, or t
  misc_feature (290)..(290): n is a, c, g, or t
  misc_feature (294)..(296): n is a, c, g, or t
  misc_feature (298)..(298): n is a, c, g, or t
  misc_feature (318)..(318): n is a, c, g, or t
  misc_feature (349)..(349): n is a, c, g, or t
  misc_feature (355)..(355): n is a, c, g, or t
  misc_feature (363)..(363): n is a, c, g, or t
  misc_feature (387)..(387): n is a, c, g, or t
  misc_feature (393)..(393): n is a, c, g, or t
  misc_feature (406)..(406): n is a, c, g, or t
  misc_feature (438)..(438): n is a, c, g, or t
  misc_feature (446)..(446): n is a, c, g, or t
  misc_feature (452)..(452): n is a, c, g, or t
  misc_feature (464)..(464): n is a, c, g, or t
aaaaanttttantaataaatttttaaaaaanntnnannantttaatttntanatnnntnnnannnatnttttntaaaaaaannaaaaaaanaaaananatnnannatnaaacnnnnccnnantncnnnnncntnttnccttcctcnacctttntntnaccnncnttcnnntnccnannnntnnncccantcanttnanncanaancccccnnattnncttnnncntcccntcncncntcnnttnnccnnnttnccncctcntnncntttcnaacntccncnaancattcncctnnncnaatttatattcccccacttntctccatcaatacaaccttatcccctttttnacaaanacttttcnttcttttctttcattatccttttncccccntttccataaaaanatattccttaaaaaaaactttttcacaccccnccaatcancccatnacatatattatnttatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366879 - DNA, 3979 bp, Homo sapiens
  misc_feature (1887)..(1887): n is a, c, g, or t
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatggctgtaggcaacaagattgttggcaacnaagaattgaagaatcatctgtaaccccagctactcgggaggctgaggcacgagaaccatttgaacctgggagacagaggttgcagtgagctgagattgcaccactacactccagcctgggtgacaagagcaaaactccatctgtggtcccagctgcttggaaaccggaggtaagaggattgcctgagctccagcatttgaaggtgcagtgagctgtggttgcaccactgcactccagcctaggcaacagagtgagatattgtctttaaaaaaaaaaaaaaaaattcatggcagagtcagaaatagaaaaaaacagccaccatttccagtcagtcttcagggaaaccttcaataaccctcacataagcattttacaagtctatttcttcttattttataaacataactgcatctttaattgggtgtacttgaataattgaaaactgaacagcaaatcaatttttatggttcattttctccaacaaacaacaatattaaactgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatatatgaactttcaagttgaagatatatttcacaggaatattcacccaaagcttgagagctagagcgaggagagacttgcagtcggtaactgagtagatgaaatgcataatttttcactaggtgataattccctttgggaagaagtgctttatctttaattattccactttttgttaaatggttcatgcttttaaactgcgattgtctcaaacttgcttgctattgaattgtgtaacatcagataatggcaagttgtcaaaagataaccccagtggataattgaagctgcttttacgagaagcatggtgctgagctgccttacacagtctttttacagtaaccataaaaaactgagtttatttgatcatgtattatcccttctcacataaagtcatattagaggaattctttttaaaagaagctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattccagatatatgaagctatatttttttgtacatcttcagaaatcagagatactgagagtggtcttcttttttttgagagggagtttcactttctcccccaggctagagtgcagtggcgcaaactcagctcactgcaacctctgccccccgggttcaagcgattctcctgcctcagcctcctaggtagttgggattacaggcacccaccaccatgcctggctaatttttgtatttttagtagatggggtttcgccatgttggccaggctggtctcaaacacttgacctcaagcaatcggcccgcctcggcctcccaaagtgctgggattacaggcatgagccaccgtgcccagccagagagacaagagtggttacttctaaaatgacaagatgatgtaaccctggctcagggagtagatcaagttctaaatctcaggaataaaaaactgatactcattatccaattcatatagtcttgtattatatacatattaacagtctatgcaatgaaaaataaagaaatttcataaaactatttcaaaactcagaacataaaaatgtaaagaaacaaaacatttaatgtacaatctactccatttggcaatgtgtactgagagataaaaaacctatctacaaacagaatata

SEQ ID NO: 366880 - DNA, 2154 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcacaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366881 - DNA, 1938 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagcctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366882 - DNA, 610 bp, Homo sapiens
  misc_feature (25)..(25): n is a, c, g, or t
  misc_feature (69)..(70): n is a, c, g, or t
  misc_feature (81)..(81): n is a, c, g, or t
  misc_feature (95)..(95): n is a, c, g, or t
  misc_feature (98)..(99): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (114)..(114): n is a, c, g, or t
gttccacttctagcctcctctaagnggcccgaaataaccgaccctgcatttggtctgggcgtttgaggnnttcctctcaanatgacaagttaggnggnngcnangnttgtttanataggcagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366883 - DNA, 2154 bp, Homo sapiens
attagccgggtaggatggtacccacctgtaaccccagctactcgggaggctgaggcacgagaaccatttgaacctgggagacagaggttgcagtgagctgagattgcaccactacactccagcctgggtgacaagagcaaaactccatctgtggtcccagctgcttggaaaccggaggtaagaggattgcctgagctccagcatttgaaggtgcagtgagctgtggttgcaccactgcactccagcctaggcaacagagtgagatattgtctttaaaaaaaaaaaaaaaaattcatggcagagtcagaaatagaaaaaaacagccaccatttccagtcagtcttcagggaaaccttcaataaccctcacataagcattttacaagtctatttcttcttattttataaacataactgcatctttaattgggtgtacttgaataattgaaaactgaacagcaaatcaatttttatggttcattttctccaacaaacaacaatattaaactgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatacaaacagtgcaaatacagtactgcaaactcagtaaaaggagtttttgattggagtatgaactttcaagttgaagatatatttcacaggaatattcacccaaagcttgagagctagagcgaggagagacttgcagtcggtaactgagtagatgaaatgcataatttttcactaggtgataattccctttgggaagaagtgctttatctttaattattccactttttgttaaatggttcatgcttttaaactgcgattgtctcaaacttgcttgctattgaattgtgtaacatcagataatggcaagttgtcaaaagataaccccagtggataattgaagctgcttttacgagaagcatggtgctgagctgccttacacagtctttttacagtaaccataaaaaactgagtttatttgatcatgtattatcccttctcacataaagtcatattagaggaattctttttaaaagaagctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattccagatatatgaagctatatttttttgtacatcttcagaaatcagagatactgagagtggtcttcttttttttgagagggagtttcactttctcccccaggctagagtgcagtggcgcaaactcagctcactgcaacctctgccccccgggttcaagcgattctcctgcctcagcctcctaggtagttgggattacaggcacccaccaccatgcctggctaatttttgtatttttagtagatggggtttcgccatgttggccaggctggtctcaaacacttgacctcaagcaatcggcccgcctcggcctcccaaagtgctgggattacaggcatgagccaccgtgcccagccagagagacaagagtggttacttctaaaatgacaagatgatgtaaccctggctcagggagtagatcaagttctaaatctcaggaataaaaaactgatactcattatccaattcatatagtcttgtattatatacatattaacagtctatgcaatgaaaaataaagaaatttcataaaactatttcaaaactcagaacataaaaatgtaaagaaacaaaacatttaatgtacaatctactccatttggcaatgtgtactgagagataaaaaacctatctacaaacagaatata

SEQ ID NO: 366884 - DNA, 2240 bp, Homo sapiens
tgctgttgttgtgcttgatccttcggcgtgttgcgtgctgttggtgttgtcgtcgctgttccttgtgatgcgctgacttgctgctgttgtttgcgctcttgtggtctgctgcctgcgtgctgtttgggtgcgcggttgtatgtgtattcgacgacctcgcgtaatatttcaaaacatactccgggccgaattttttctcccccccgccataatgctccgggggttcacccctcgaatcacctccatgttttatttctccccgcggctgttatacctctctgggtgggtgggtccgccctttggtcgcccccccacagtgggggggtcttctccccacgagccccaagtacgtgggtttccccacaccgccggtgtttaaccccgcgcccgccgctctgctttatatctcggccccccctatggggccccgccttggtcaacaaagagacgggggtgctcgtaattcgtggcgcccccccccggggttttttttctcgccccccccccccttttttttttgtgtttgttttttttcctgttgtgtttttctttctttttttttttttttttttttttttttttttttttttttttgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatacaaacagtgcaaatacagtactgcaaactcagtaaaaggagtttttgattggagtatgaactttcaagttgaagatatatttcacaggaatattcacccaaagcttgagagctagagcgaggagagacttgcagtcggtaactgagtagatgaaatgcataatttttcactaggtgataattccctttgggaagaagtgctttatctttaattattccactttttgttaaatggttcatgcttttaaactgcgattgtctcaaacttgcttgctattgaattgtgtaacatcagataatggcaagttgtcaaaagataaccccagtggataattgaagctgcttttacgagaagcatggtgctgagctgccttacacagtctttttacagtaaccataaaaaactgagtttatttgatcatgtattatcccttctcacataaagtcatattagaggaattctttttaaaagaagctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattccagatatatgaagctatatttttttgtacatcttcagaaatcagagatactgagagtggtcttcttttttttgagagggagtttcactttctcccccaggctagagtgcagtggcgcaaactcagctcactgcaacctctgccccccgggttcaagcgattctcctgcctcagcctcctaggtagttgggattacaggcacccaccaccatgcctggctaatttttgtatttttagtagatggggtttcgccatgttggccaggctggtctcaaacacttgacctcaagcaatcggcccgcctcggcctcccaaagtgctgggattacaggcatgagccaccgtgcccagccagagagacaagagtggttacttctaaaatgacaagatgatgtaaccctggctcagggagtagatcaagttctaaatctcaggaataaaaaactgatactcattatccaattcatatagtcttgtattatatacatattaacagtctatgcaatgaaaaataaagaaatttcataaaactatttcaaaactcagaacataaaaatgtaaagaaacaaaacatttaatgtacaatctactccatttggcaatgtgtactgagagataaaaaacctatctacaaacagaatata

SEQ ID NO: 366885 - DNA, 1512 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatggtaagagaacttgagtatagaacttcctttatactttccaggttttcttcacttgcggtatcgactccacacacctctgtcctgcctgtcaccctaaatgaccagcagacaaatgggtaggacagtcaaacccacactctgaccttggaggctgatgctaagggagtgtgatttgctaaaccaggggttggccaactacagcctgcaggccaaatcgggcccaccacttgtttttgtaaataaagttttattggaacacacagtta

SEQ ID NO: 366886 - DNA, 411 bp, Homo sapiens
gatgataggaaacccggatataaggcagaacaatgttgcttgggccatctcttacacctcagtgaaacggaaaatgaaggaaatggaaggctggcatgggaaccccgacttatacagtgatgcccttttgctgttccacgcgtcgcttggggtggaagcccttccttgtcccctcgccacccaccccggagccccttggtgcttcctttctgaactgaatgcttagactggggaactagaggtgcccggaaagggaagtcgggaagaagagactattcctgttggttcctccccagagatgggagatggtgaacaggcgtgtggagggcggaataatggtccccaaagatgtccacgccctcatcctcagagtccgtgaacctgggaatgtgctgcctgacgtacaaaagg

SEQ ID NO: 366887 - DNA, 488 bp, Homo sapiens
agctatcagcctctttggccacacaacacaccaattttcacacataaaatgtgtccactgccagccagtgacccactaaaaatggcatcttgttcttctttggttgtcgtgttcacagtgaatttgaggaaacatcagaaaagatgtaggcagcttggccatgttcatttacatgtgtgcttgtgatgtttttaaaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatggtaaaatataccttcttatgtcctttctgaactgggaaaagaatactcctccaatagtgaaatcggggaatgcttatgaggtcatgggtggtgggagtggggagacccagtgagaagagtgctgaact

SEQ ID NO: 366888 - DNA, 348 bp, Homo sapiens
aatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaa

SEQ ID NO: 366889 - DNA, 1585 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctcaatgccttggtttcaacactatcggactgtgactgtcgggcctccagaaaacattgaggtgacccaggagaaggctccctcatcatcatgttctcctctccctttgacatcgctgataactccacggcctcttcggc

SEQ ID NO: 366890 - DNA, 1594 bp, Homo sapiens
ggcggcggcggcggcggcgggcgagggtgaccggccgagcggcggcggcatggagtagacgcgccgccgccgcggcccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366891 - DNA, 2514 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtagaaacggcatttctccatgttggccagactggtcttgaactcctgacctcaagtgatctgcccacctcagcctcccaaagtgctgggattacagtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366892 - DNA, 2367 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366893 - DNA, 2294 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366894 - DNA, 3779 bp, Homo sapiens
  misc_feature (1887)..(1887): n is a, c, g, or t
  misc_feature (3500)..(3500): n is a, c, g, or t
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatggctgtaggcaacaagattgttggcaacnaagaattgaagaatcatctgtaaccccagctactcgggaggctgaggcacgagaaccatttgaacctgggagacagaggttgcagtgagctgagattgcaccactacactccagcctgggtgacaagagcaaaactccatctgtggtcccagctgcttggaaaccggaggtaagaggattgcctgagctccagcatttgaaggtgcagtgagctgtggttgcaccactgcactccagcctaggcaacagagtgagatattgtctttaaaaaaaaaaaaaaaaattcatggcagagtcagaaatagaaaaaaacagccaccatttccagtcagtcttcagggaaaccttcaataaccctcacataagcattttacaagtctatttcttcttattttataaacataactgcatctttaattgggtgtacttgaataattgaaaactgaacagcaaatcaatttttatggttcattttctccaacaaacaacaatattaaactgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatacaaacagtgcaaatacagtactgcaaactcagtaaaaggagtttttgattggagtatgaactttcaagttgaagatatatttcacaggaatattcacccaaagcttgagagctagagcgaggagagacttgcagtcggtaactgagtagatgaaatgcataatttttcactaggtgataattccctttgggaagaagtgctttatctttaattattccactttttgttaaatggttcatgcttttaaactgcgattgtctcaaacttgcttgctattgaattgtgtaacatcagataatggcaagttgtcaaaagataaccccagtggataattgaagctgcttttacgagaagcatggtgctgagctgccttacacagtctttttacagtaaccataaaaaactgagtttatttgatcatgtattatcccttctcacataaagtcatattagaggaattctttttaaaagaagctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattccagatatatgaagctatatttttttgtacatcttcagaaatcagagatactgagagtggtcttcttttttttgagagggagtttcactttctcccccaggctagagtganactccatctgtggtcccagctgcttggaaagcggaggtaagaggattgcttgagctccagcatttgaaggtgcagtgagctgtggttgcaccactgcactccagcattttgaagaaaaaacagcaaagaaagaaatcatcaaacaagatggtatcttgacaaaggcacagcgctccacaactgcttcatactctgtgcacaagaaatcctctcgagagaggagaggagtgatgccaaatgggcttacattagacccgtggacactaccactgggattat

SEQ ID NO: 366895 - DNA, 1993 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366896 - DNA, 1409 bp, Homo sapiens
taaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagccctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctaaaaaaaaaatt

SEQ ID NO: 366897 - DNA, 476 bp, Homo sapiens
tgaagatacatggttaaaagttgaatcaaaagcaacagcagccacaataataacaagagcaacaacaaaacaaaagctgcaaacaaacctactttctttccttatgttactgtatgacatcattgctttgagtaaagaatacagtagtattaatttaaatgcttaaatttatatttatacaaatgttgatagcatggtcattgaaatagttttgcaagtcctcacaggttttcagtttaccatataaagagattgatctgtatgtgtaatttgtgctttaagtggtagttttaatagttactggacctcacagtttaatgggcatgtttataatgctacatcaattaccacattttctcatagttctgtatattgtgagaagaaaatgaaaaaagtgctgtttaactaagtacaggaatgtggagccaggaaatctcatgctctgatgccatttcttctcccagtgttctttgtaa

SEQ ID NO: 366898 - DNA, 1217 bp, Homo sapiens
ctgagaccgcctcctgacatatggaggaaagtcttattttgagtcctgggtgtcacccttttttcaggtatagtaaacttatcctccacagggcccaaggccctgtggctgagggcagataatgtaggtctcaccgtgagggtggtcgtttgaaaaagtgccctgaatgatttgtctgctctctccctagaatatgccctacagagataggtatattcagccacattttccattcagggtagcaaacagtatgccagatttggcttgcagatggggttttggcccacatattttttaaaatttcacataaaatattcattgaggagtccagatttttagcctctcttgtaaagttggactctggcagtgcagatccacattcccacatggcatcaaagttcccctttgaagagcacgccctttgcctttctccttcacttgtctggccctggtgggctgtgtagtctgccaccctcaggggattcgttttccagccaaaccttgctcggccactgttcttatctccatgcagcccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaa

SEQ ID NO: 366899 - DNA, 355 bp, Homo sapiens
gtctgtcttggaacgggctgctccaggtctgtgttcgagggcttctggctccatgtcagtgttgtgaaactctccaggggtggcctggaggccaagcagatgtggcagttctgcagcagaagcatctgccactgcctttggcttggggacatggcaggtgaccggcatctggtgtgcgtaactctgggcccttgaccttgctgccatctgcttggccttatgctctgtcactgtaggtccagcgtcggaagtggaagctgaacctgattgcagagttggagtccagagttctggctgagcctgtccctctgccagccgagtgagtgcatggctgcccccctgggcctgttttact

SEQ ID NO: 366900 - DNA, 769 bp, Homo sapiens
gcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggtgagggctgcaggccgggctgtgatccaggcgcctgggcagagccacctgctgtctgccctgcactttgaagggttgtcgtggggattgaaatgaaccaactgccggctgagcggaggctccctgggagtgacaagttccgtattaaaatgctttcagtggaattgtggtcgtgtgccgggcatgtagcgagcgctttgtcctcacaacgcgagaggtagctccttggtcgttcccctgttacagagaaggctcgagagttacttccgaacgtcccatccagctaatgggtggccagcccaggctgaaagcccagggctctgaaagtaaagcgtatctaaccaccgcggcttacgtgttcctctcagtgtgcagcacagggctgttttgccgtgtgtagagtgctgtgcaagcctgccccaggcctgcctttttataaa

SEQ ID NO: 366901 - DNA, 957 bp, Homo sapiens
tcggtgaacgggtatggtgaacatatttaattacagacattaaatagctggggaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaa

SEQ ID NO: 366902 - DNA, 1753 bp, Homo sapiens
gcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaaaaaaaaaaaaaaaaaaaaaaaaaaaaaaaaaaaaaaaaaaacaaaaaaaaaaaaaaaaaaaaaaaaacacaaaaaaacaaaaaaaaaagaacacaggggcgcggcgaccgcaaaatcactacacggaaggaggggagccacaaaagagaacacacagcccacgcgctatagagcagaaccgcgaggcccacaaaaaagaggacacataacacgaagaagcagagcagagactacacaacaacaacacacgcgaggacgaaggaaaaaccaagacgagtaggcgagacgcacagagacgaaagaaacacaacacacctgtgggggagcggcaaaaataaatgagatgaggaccaaaacaccacgtggagtaagagtatcactacccgcactgagcagaaataaaaacacacactgacgcctgcgcgtagccagtggtggtagacccaagcagatatctatttcgtagcacggcagaactatgacgtatcagaaggagaatatctcttacgaaaagtattacac

SEQ ID NO: 366903 - DNA, 362 bp, Homo sapiens
gtacgttgtggaccagcccatctcggaacaagtagcttttgtgaatactgtccttcctcctaaccctcattgcccagtcactactgtggcttatgttctcacatgtgtatatggcgggtgggaggaggcagcaactcagcaaagaacctaggcaagtactgagcggacaagggcggggatggtcacccaacgtaaaggccatacaggacttccaactggccacgcaaaaatgacagccactaggaagtggtgcagaggctggcaggccagtagggggtggacttgagtctgctgtctccacagagagcacagtccctggaggacccattggagggcaaaccagagttactctgaggaacgag

SEQ ID NO: 366904 - DNA, 1231 bp, Homo sapiens
gcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaa

SEQ ID NO: 366905 - DNA, 1179 bp, Homo sapiens
gcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaa

SEQ ID NO: 366906 - DNA, 1257 bp, Homo sapiens
gcgaaccttgcgggcgtccgtctggagccgcaggctcgggtgctcccgcagaaacgcccgcacgtcgcccggcaactcgctcatggccgacgcgcccgcggagcagcccggcggaagccgctcgcagaacctggagccgggggcggggctctgggcgggactcagcggcgccccggatgcagatgcctcctgcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaatgagctcatgactggttcatcataaa

SEQ ID NO: 366907 - DNA, 2878 bp, Homo sapiens
atcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaatt

SEQ ID NO: 366908 - DNA, 1432 bp, Homo sapiens
atcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcgtgagtagaccgagaatcctgcccgatccccgcccctgggctggtgtcgccctgggctcctgggacgtcggggcactgtcccccgatactggcagaaaaggattgagtcctcgcttttggccctaggtctccttgagcctccagaggactcacaacactccggggcatgttgctctttcaaataccaggaatggactctggggaatggggcacccttgaagtctgattatttcttccctgtagagccccaggggctaattaaactcgtgtttatggaa

SEQ ID NO: 366909 - DNA, 1458 bp, Homo sapiens
gcatggtcaggaactccgggaagtcaatggtcccgttcccatctgcatccacctcattgatcatatcctgcagctctgcttcgcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattttattattattattattattattattattattattattattgagacagagtttcattctgctgcccaggctggagtgcagtggcatcatcttggctcattgcaacctctgccttctgggttcaggcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcag

SEQ ID NO: 366910 - DNA, 1030 bp, Homo sapiens
agtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattgagacagagtcttgttctgtcgccaggctggagtgcagtggtgcaatcttggctcactgcaacctctccctcccaagttcaagcgattcttctgcctcagcctcctgagtagctgggattacaggcatgcgccaccacgcccagctaatttttcttttttctttttatatttttaatttatttttaagacggagtttcccttttgttgcccaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagt

SEQ ID NO: 366911 - DNA, 709 bp, Homo sapiens
ggacttagctctccttcagctttgtaaatggtttctctctctcatcccccagaagaaccagtgaagaaatccattcaggaatcagaagcttttttgcctcagagcatacctgaagagagatacaagatgaagagcaagcccctaggaatctgcctgataatcgattgcattggcaatgagacaggtaggtgtggaagctgcagattaactggtgcccccagattgagatcatggcacaggcaagctgtattcattggagtgatcagcaccaactgccgtgacaaaccagttcaagaatctgtgcttcatcctgggtgcggtggctcatgcctggaattccagcactttgtgaggctgagatgggaggatcacttgagcccagttaaaaattagctggtgtgggctcgggcacggtggcttacacctgtaatcccagcactttgggaggcggaggcgggcggatcatgaggtcaggagttcaagaccagcctggccaatatggtgaaaccccgtctctactaaaaatacaaaaattagctgggcatggtggtgggttcctgtagtcccagctacttgggaggctgaggcagaagaattgcttgaacctgggaggcagagcttgcagtgagccgagatcgcaccaccgcactgtagcctgggtgacagagcaagattctgtctcaaaaaaaaaaaaaattagctggtgtgg

SEQ ID NO: 366912 - DNA, 348 bp, Homo sapiens
  misc_feature (326)..(326): n is a, c, g, or t
  misc_feature (335)..(335): n is a, c, g, or t
ttttttgagatagggtcttgctctgtcgcccagcctggagtgcagtggtacagatctcggccttccaggttaaagcgatactccgccgagcgctgagcatacctgaagagagatacaagatgaagagcaagcccctaggaatctgcctgataatcgattgcattggcaatgagacaggttggagtgcaatggcgcaatctcagctcactgaaacctctgcctcccaggttcaagcgattctcctgtctcagcctcccaagtagctgggaatacaggtgcacaccactatgcccagctaatttttatatttttagtagagacagtcncgctgtatnctaagcggggtcg

SEQ ID NO: 366913 - DNA, 3808 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366914 - DNA, 3482 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattttattattattattattattattattattattattattattgagacagagtttcattctgctgcccaggctggagtgcagtggcatcatcttggctcattgcaacctctgccttctgggttcaggcgattctcctgcctcagcctcccgagtagctgggattacaggctcctgccaccacacccggctaatttttgtatttttagtggagacagggtttccaccatgttggcagcctttgggagccacagaggccattcctccaggcagaatcggccctgcccctg

SEQ ID NO: 366915 - DNA, 2898 bp, Homo sapiens
  misc_feature (2895)..(2896): n is a, c, g, or t
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttacttgggaggctgaggtgggaggatcttttgaacccaggagttcagggtcatagcatgctgtgattgtgcctacgaatagccactgcataccaacctgggcaatatagcaagatcccatctcnnta

SEQ ID NO: 366916 - DNA, 3939 bp, Homo sapiens
ttgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366917 - DNA, 2124 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttta

SEQ ID NO: 366918 - DNA, 4592 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366919 - DNA, 2253 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacatagttcagcgtctgacgtcagacgctgaactatgtggtcatgaggatgcccagaatcagggcccagatgttcaggcacttggcggtggaggcataggcctgggccccggtcacgtcgccaaccatcttcctgtccctagacttcacggagtaggcgaatgctatgaagcccaggcagcaggggttcatgaagagggtgttgaacagggaccagacgacatggtcgggcacggaggtctcgctgcggatgtggatcacggtggacgtcgggggagcagggttgtggggcgcccccagcacagccactcgtgctcctcccttgagcatcacatag

SEQ ID NO: 366920 - DNA, 3297 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366921 - DNA, 2719 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtgggtttgcatctgtatctgtatgtatatatatatatacatacatacatacatacagttggacaattggacatttttttcactgttcatttattcacttgaaattgtaacttaaaaaaagaaaatgtaactttaaaaataaaaatagatgcaccatgcctatggaaaaaaatttaaatgtactacaagaggttttaaaagtatttttttgcccgggtgcggtggctcatgcgtgtaatcccagcactttgggaggccgagccggaaggatcacctgaggtcaggagttcgagactggcctggccaacatggtgaaactccatctctactaaaaaatacaaaaattagccaggtatggtggcaggtgcctataatcccagctacttgggaggctgaggcaggagaatcatatgaacccaggaagtggaggttgcagtagccaaatcgcgccattgtactccagcctgggtgacaagagcaaaactctgtctcaaaaaaaatgttttcttcctacccctataatactgacctccaattatttttcctaaaggcagctgttgtgaactagttcattctgtaactatccagagatagtctacacatatatttcatttttgcttttttctcttctacagatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaac

SEQ ID NO: 366922 - DNA, 1793 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaac

SEQ ID NO: 366923 - DNA, 4538 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366924 - DNA, 1397 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcca

SEQ ID NO: 366925 - DNA, 2976 bp, Homo sapiens
cttcatgatgtttggtcgaagagtcatctgaaattttgaattcagtaaggtggctagaaagtttagggtattttgaaagatggtgattgaccttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366926 - DNA, 4201 bp, Homo sapiens
atcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366927 - DNA, 4174 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366928 - DNA, 3186 bp, Homo sapiens
gacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366929 - DNA, 3117 bp, Homo sapiens
gctgctagatatttggtttaacatgggtcattatcatggttggatcaatgtttaacatggcctgattagagctccattccatttcagttataaacatcacattttttaacataccgcccaaatgatgaaacccatggagtaccatggggttcaaacttaaataagctaattcaatagacaactagaaatgcccatgagtcttatcgtagaatttaacccgtttttattttgagagcttacttagattatgtagataaaggaaatgaccaactctaaaaatgcaatatttgtactagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366930 - DNA, 3192 bp, Homo sapiens
caaaaaaagaaaaaaaaaagtgaccctgattattcattcattcatttagtaagcaggcactatggcatatgaatgcagtgactttcttaaaaggtttaggagccgaatacctagaagttaattcatatgaggctgcagaagtgcttcaaaaattactgtatgattaaatgccacaggataccacaagatattatagaattaaaaaaaggtgttgggattacaggtgtcagccatcgctcccggcctattttcatcttttaaaagcagaatttccctgttctttggtaatatgatacgggatttatggagttaacagctcttgctattctttagataatttaactgttgggacgatatttttatttttttcctgagttaagaatcctattgagacatttaaagaggtgtaatgtatagtgtacctctgaaataactaacaggaagtatgaccttattctttgtatttgaagctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366931 - DNA, 1342 bp, Homo sapiens
ttgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgt

SEQ ID NO: 366932 - DNA, 1528 bp, Homo sapiens
ttgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcca

SEQ ID NO: 366933 - DNA, 1205 bp, Homo sapiens
tcgctctagagtatcccctccccgtacgcccaagagggagaccgtggaaagagagagagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366934 - DNA, 1364 bp, Homo sapiens
gggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366935 - DNA, 1200 bp, Homo sapiens
ttcctctacaacttgatgaattttatttcattttcttgtgtaattgccctgctagaatctccaggacaatgttgagtaaaagtgatgagagtggacatccttatctaccttctgatgttagggagaaaacattattttttttttcactaatgagtaagatgttggctgtaggtttttcatagattgctatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366936 - DNA, 1551 bp, Homo sapiens
gtgttagctccagccaccagtgagtcaggagaggctttctaggcaaagacatctaagttcagaatccttgtgatccagatgcctgtaccctttgagttcagaggtgggccagggtatctcaggtatttctttcctttagcatcttgcaattcaaaatatggtccttgaatcaacatcacctgagagcttgttaaacagagaaggctacttcaaattctatttctgtcttttatgttagtcatttgggttcttaagtcatttcactgtaacctctgggggagctaggggattctttaaggaagtttccattctctgagttgttttcagaaactgttagttggcaaaggatgtaccatctcctattaaacgggcaaggacaagttcccttttctgaggtcccttaagatctcttcctggggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgattctgaatgattaaatcgtttcattttctaaatgtgttataatgtgtttagccctttcttgttgctgtatgtttagatgctttccaatcttttgttactactaataatgctataaaataaatatccttgtacttctttgtgcatttgtttttttactgagctaattttaatgatttcagcaaaagttattttgttattgagtgatgaaacaaaagatttttgagggtgttcatgagcataagtatcatatagtcacttatggttgttgtgttcctagtacttagtacaaggtatcggaattgttctttagttaatcttttatcttgagaagttaaatcttggtgtaatcttatcctcatgttcatataaagatatgtggagtttgtagtgaggacttagagccgggtacaatttcatggttaaattagaaatgcttttggcagtgttaacagctcttttagaatttgtctagcaggcttttcagtttttgccagaaagccctaaaaaaaaagaaggaaaaaaatgcttttggctgagtgtggtggctcacgcctgtaatcccagcactttgggaggccgaggcaagcggatcgcttgagcccaggagttcgagacaaac

SEQ ID NO: 366937 - DNA, 1306 bp, Homo sapiens
atcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcgtctccttgagcctccagaggactcacaacactccggggcatgttgctctttcaaataccaggaatggactctggggaatggggcacccttgaagtctgattatttcttccctgtagagccccaggggctaattaaactcgtgtttatggaa

SEQ ID NO: 366938 - DNA, 498 bp, Homo sapiens
tcgctctagagtatcccctccccgtacgcccaagagggagaccgtggaaagagagagagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggcagaagactcgcttgaacccaggaggtggaggttgcagtgagctgagatcacgccattgcactccagcctgggtgacagagcgagatgctgtctcaaaaaaaaaaa

SEQ ID NO: 366939 - DNA, 866 bp, Homo sapiens
aagtgatcctccacctctgcctcctgagtagctgggaccacaggtgtgtgccaacacactcagcttattttttttattttttgtagagatgggggtctcactattttgctcaggctggtctcaaactcttgggctcaagcagtcttcctgcctcagcctccaaagtgctgggattacaggtatgaacttctgcacctggcctagctagctctattgacatttgttttttgttggtggttctcttagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcca

SEQ ID NO: 366940 - DNA, 425 bp, Homo sapiens
cactcagaagagagaaagattgtgaggtctggacttcaataagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccgtgtttgttttttgttttccccagagcttcttcgagacaccttcacttccctgggctatgaagtccagaaattcttgcatctcagt

SEQ ID NO: 366941 - DNA, 2229 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttta

SEQ ID NO: 366942 - DNA, 1311 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctt

SEQ ID NO: 366943 - DNA, 836 bp, Homo sapiens
gacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataa

SEQ ID NO: 366944 - DNA, 2067 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaatt

SEQ ID NO: 366945 - DNA, 3835 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattttattattattattattattattattattattattgagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366946 - DNA, 3510 bp, Homo sapiens
  misc_feature (3369)..(3369): n is a, c, g, or t
  misc_feature (3375)..(3375): n is a, c, g, or t
  misc_feature (3507)..(3508): n is a, c, g, or t
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattttattattattattattattattattattattattattattgagacagagtttcattctgctgcccaggctggagtgcagtggcatcatcttggctcattgcaacctctgccttctgggttcaggcgattctcctgcctcagcctcccgagtagctgggtgtgggtgtgggtncctgtnttcccagttacttgggaggctgaggtgggaggatcttttgaacccaggagttcagggtcatagcatgctgtgattgtgcctacgaatagccactgcataccaacctgggcaatatagcaagatcccatctcnnta

SEQ ID NO: 366947 - DNA, 2967 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatgagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366948 - DNA, 2076 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcacatgcgttgggagcggcacatgcgttgggagcggcacatgcgttgggagcggcacatgcgttgggagcggcacatgcgttgggag

SEQ ID NO: 366949 - DNA, 3800 bp, Homo sapiens
ccggattcccagaaaggggcgacctgggccacagcggtacaagctgcaccccgatggacctgagagaccggaagtaacccttggccaactctggccgccccctgcagccgcagccccagaggcccacccgcgagcttcagtggcgggccctcagcgtcgtgtaaactttgcttaaaatgatcttgagagttcaattcttggggtgaactgttgagaagatctggcatttttcctttcgaaagttgttgggaacgtggactttcccaacaattgtgtatgcgctcgatctcactcagtgggagccgccgccctggagggaatttcacaatagcctgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366950 - DNA, 3731 bp, Homo sapiens
ttgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaataactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366951 - DNA, 3625 bp, Homo sapiens
ccggattcccagaaaggggcgacctgggccacagcggtacaagctgcaccccgatggacctgagagaccggaagtaacccttggccaactctggccgccccctgcagccgcagccccagaggcccacccgcgagcttcagtggcgggccctcagcgtcgtaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366952 - DNA, 4329 bp, Homo sapiens
atcttttttttttttttttttttttgagacagcatttcactcttgttgcccaggctggaatgcaatggcactatctctgctcaccgcaacctccgcctgtcgggttcaagcgattctcgtgcctcagcctctcaagtagctgagattacaggcatgcaccaccatgcccggctagttttgtatttttaatagagacggggtttctccatgttggtcagtctggtctcgaactcctgaccttaggtgatccgcccgcctcggcatcccaaagtgctgggattacaggcgtgagccaccatgcccggcccaactccaagatctaaacaaaaaagactgggttgaaagggagtttttaatgtttactgtttgctttacatccattttcttgttttgttaatacttgctttacttaagcttttgggtcaaatgtcctcgttaaaatggctttctctagcgactttatgttttacgtttctgtttgtaactgacatttgaccttcttttaacacggtattacttgcttccttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcagcggctgtccccactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366953 - DNA, 4647 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366954 - DNA, 3422 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366955 - DNA, 1900 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctggaagaatacctgctatgtaggtgttcaataaataattgttgggtgaatgaatgaaggaataagctctcccagtgtcagtgtgtttctaaaagccattcctttttatctttagagtttagcagactctcttctacctatcttcccttctctcctcaaaaaaccagacttttatccaaaaagcatgcaagt

SEQ ID NO: 366956 - DNA, 1834 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcatcacatagttcagcgtctgacggtaccgc

SEQ ID NO: 366957 - DNA, 3754 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366958 - DNA, 1487 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctggtaagaattttggcctctcagtggtctaggggaagtactctgtgcatgggggtgggcatcatgactgataaatattcatttgttggataggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcca

SEQ ID NO: 366959 - DNA, 4404 bp, Homo sapiens
gtgttagctccagccaccagtgagtcaggagaggctttctaggcaaagacatctaagttcagaatccttgtgatccagatgcctgtaccctttgagttcagaggtgggccagggtatctcaggtatttctttcctttagcatcttgcaattcaaaatatggtccttgaatcaacatcacctgagagcttgttaaacagagaaggctacttcaaattctatttctgtcttttatgttagtcatttgggttcttaagtcatttcactgtaacctctgggggagctaggggattctttaaggaagtttccattctctgagttgttttcagaaactgttagttggcaaaggatgtaccatctcctattaaacgggcaaggacaagttcccttttctgaggtcccttaagatctcttcctggggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366960 - DNA, 4530 bp, Homo sapiens
ttgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagagaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366961 - DNA, 2999 bp, Homo sapiens
agaggagtcccggaagtgtactgtgttacatgggccgagggagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366962 - DNA, 3010 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacactacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagggatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcgatctcagctcacaatcactagtgaattcgcgaggccaaggcgggcggatcacgaggtcaggagatcaagaccatcctggctaacatgtaaaaccccgtctctactaaaaataca

SEQ ID NO: 366963 - DNA, 890 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataacacgtttcgcgagatttcaactgttacacaggaagtagagaaaaaggaatctgaagaggctgggtatggtggctcacgcctgtaatcccaaaa

SEQ ID NO: 366964 - DNA, 280 bp, Homo sapiens
ccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaaggtgagcccccaggaggtggtcagttccggaccacctgcttattttcgtgccaccaggatgggaattacca

SEQ ID NO: 366965 - DNA, 1356 bp, Homo sapiens
acttttctacattctacggtgagagaacatcatcaattatgtaaaattctttctaaactagcttttgaaatgagtcactcaggcttaaagcaggttattgtagcttctgaggaaagtgagtgctccaattcctttaaagaacgttttcaattggaaaagagtaagatgaaatctaaatatttgaacttgctaagtaatgatcacaatctatggcccaggctcagaaaatctgctactgaaccttaaatgttgagaataagacaacctcattttatgattctctacatgtggaatttatactgtaggtttttgttgtttgtgggggttgtgtgtgttctttctaagtaagccttcatgtggtatttttgcacacaaaatgttctagctttgctttctaaagctgttctcagctgtggtacatcatggaccactcaaatgaccttccatcgtttgctgtttttctcaacgttgattgaaatgtcttaagttagcctcaggaattcagttctgttctttgttctgtccctcttttccttctgaccttggagcagataatcagctggtcagtgattctgtacccctatagtcatgcaaatagacagaaacacactcatgtgttgtacaaagcctggcccaaaatactcatccttggcttgcttttgaaggtgcctctgagaggacatttctgcaggactctatctgaaacctaaaaatatcctgtttccctgaatgaaaaggagaaagctattgagtttagtaggaaactcaataaatggtattaagcacggccttatgaaggaagattaacaaatgattatttatcatgtttgtccttaagggtccagaaaagcaacactgagtatattgttggagatgtcacatgtaagcatattagcaagatacttatactaaccgaagtgctacttgagagactattgtattaataacaaaaagatactagaagttgcttcaaatcttttctcttctaccatttacacaatgccaaggaaatagagaagtgcagatgtacataattgtacccaacagatgtatatctgaaaaagatgtaaatcaagttacattttaaattcagcagagaaactcagaacattaaaggagtataaaatatcggtggtatagcaaaaaaaaaaaaacccctaatttatgttttaccagttggcattataaatcctgttttacatactttgtgggggttgagggagttagggaacctatcttatcatacctcagtatttctcctgcattccttctgtggaaattattcagagatttactttgaagttacattgtatagtagaatagttcattacccctcaaatgattgctcagcccact

SEQ ID NO: 366966 - DNA, 4815 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaaca

SEQ ID NO: 366967 - DNA, 1075 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtaagacttgttctgttgtgtttcttttgcctgggtgatagctcccgcctgctggatccccattcatgaagctttaataggacaagcccaaactcaaatcaatcttgagatttagtattgagacctttatatagaatctctattcggggtatgtgataatagcagacttgttttgtgaatctatttattaaggatattttctgattgtgtatattgcagagcacattgaggcttggagaatgcatttgtaaacaccatacctccattaggtgatttctttctaattcttgcaaatgtctaatcatct

SEQ ID NO: 366968 - DNA, 5219 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaacaaaaaaagacaacacaaaaaaaaaaccatgtggcccgcttgggccaagcgaattttaacatcagccaagcttatcattccgcccgaattcagactaattgccccatttccccttatagggagccgtttacaattaacgggccggcgttttacccggtcgcggg

SEQ ID NO: 366969 - DNA, 5217 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcaggtgagatgcctgcagatcacggatctgtacttaaatgctttcagccttatgccttggctcctggagaaaaccacactgccaaagttcaggtaacagagttcaatggaatttgatgaaagtcacctaagggcctcattttcctttctctttctttgaacagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaaca

SEQ ID NO: 366970 - DNA, 4337 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgtta

SEQ ID NO: 366971 - DNA, 1079 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggttggagtgacagccctggatacctccagccagctgttcctttcagataatgcacggaacttaagctgcagctgactggtgaagaggcgcccctcgggccctccgatcgggtggtcgttggcgctttgctcctttcgtgtcttttttggagccaagcgttgcatgctcatggccacgtagaccttgcagaagcgctgcggctttttcccaaattgtgcaggaccagcccgacggggcgtagggtaccgcagtggccgccagcccggcggaggtggggggcttcagtcccagagacagcttcccagacgctcacgggtccttgcagggggctggggtcctggcgcggggttcagcttttccagtagcagcagtgtaagagaagtatgcatgtagacgtgggtcg

SEQ ID NO: 366972 - DNA, 5057 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaaca

SEQ ID NO: 366973 - DNA, 5003 bp, Homo sapiens
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaaca

SEQ ID NO: 366974 - DNA, 4530 bp, Homo sapiens
  misc_feature (4455)..(4455): n is a, c, g, or t
  misc_feature (4516)..(4516): n is a, c, g, or t
gcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttgcagcgctcctggactgggagtttgttggacgtttctgtctgggttttgaagtgctgggagttgaggtcactgctgcagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttacatagctggnagtttcataaggaggaagcacgaaacatcgatggaatatgtatgtataccttggatgcaantccttctttcctgg

SEQ ID NO: 366975 - DNA, 1239 bp, Homo sapiens
ccatgttggccaagctggtctcaaactcctgacctgaggtgatccacccgcctcggcctcccaaagtgctgggaatacaggcatgagtcaccgtatccagccacttcttgacattctttctagcagtttttataccactgcttcccttctggaagccttactgatgtttaagttacatgttgatactcactttgtttttgtgcttccctttctctttcctggacagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggtaagagtattacctcatagcagtttataactttcactgtctacaggatgcttactggagggtcaagccatctggagattctggaatcagttgttgttgattgtgagatgctcttggagaaggagctgagcagtcccaacagttgtcagatgtgtagattctccatttgtgtgcagttttgaggctgtcgttgggcatttattaggccttggcctacgaaggagctgttctgtgctcaaggtggcagctatggctgcttgggcgctttctctgtgctacctcacccaccagagcatcagcactctgtcagttgcctgcccgcctgtgttccctgcagatctgtgaactccttgagggttgtgctatcattgtgtcctcagtactatagtggatacataatacattttggtttagtaaaattaatacagccctcagcattgttcggatgcctgagacccatgtattgataggatttttttctgaggtaagaaaatgattaggatgtttgggatatcttctggttatgccgctcctctgacaacttgatgctatcacaaaggtagactgtcttgggaaatttttttgcattgttcttgaaataattaagttttacttgtgttgaaaccatttgctttattcatttgagctctcatgtgtccctttggccttccagtttcactaaggtgggttcttgagcattcggagttgggctcaggaacacaggcttaaactaatttgaaactaaggtagggattacagccttccaatctgttctttctaactctgatattatctacagtggtattaagtattgtgtggtgtggacagcctactaggctctgctgataatttcagcagcatcgtgtga

SEQ ID NO: 366976 - DNA, 7329 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgctccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366977 - DNA, 5519 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgctccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccc

SEQ ID NO: 366978 - DNA, 6169 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaattgagcatgtgcgtggggtgggggtgtgtgtgcacatgtgagtgtgagtgtgtgtgggcgcttggtggggggttggggacagctggaaggtgccaggtgcacttggggttggggttggtgtgttgggtgttgaagtggaatcgtttcatcccagccatggaggccaccagcaggagtgttcatggggatgtgggcgaggtggggcactttgaaggaatggcggtctgctggtgccctcgaaggggcatccttcctggtcttcgctgacccagaggcgctgtgcctgcatatcatccaccaccaccctagcccagccttcccactgccccaggaaaagctcttctcctggccacctctgccc

SEQ ID NO: 366979 - DNA, 5522 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacatgagccaagatcatgccactgcactccagcctgggcaacacagtgagactccatctc

SEQ ID NO: 366980 - DNA, 4928 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcctgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagt

SEQ ID NO: 366981 - DNA, 3919 bp, Homo sapiens
agcgggggggccaggaagccccaggcacacagtgccgcccttcagcgggggcctgggacacagaggtgggccagacccctgggccagtgccactgccaggtgtgccagccttgggcacaggctttgggggaaagagtggggttagtgtcatccaaaagccctgggctgtcctcagagaaggcccatcacagagcacgccctggggtggccaccagcctcggccatgaaaggcaaggctttggttttctctctcctcagaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366982 - DNA, 3726 bp, Homo sapiens
agcgggggggccaggaagccccaggcacacagtgccgcccttcagcgggggcctgggacacagagaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366983 - DNA, 4402 bp, Homo sapiens
  misc_feature (4358)..(4358): n is a, c, g, or t
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccgccatgngtggattgccagctggcaatccacgcatggctggctggaggagt

SEQ ID NO: 366984 - DNA, 4976 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggtaagagtattacctcatagcagtttataactttcactgtctacaggatgcttactggagggtcaagccatctggagattctggaatcagttgttgttgattgtgagatgctcttggagaaggagctgagcagtcccaacagttgtcagatgtgtagattctccatttgtgtgcagttttgaggctgtcgttgggcatttattaggccttggcctacgaaggagctgttctgtgctcaaggtggcagctatggctgcttgggcgctttctctgtgctacctcacccaccagagcatcagcactctgtcagttgcctgcccgcctgtgttccctgcagatctgtgaactccttgagggttgtgctatcattgtgtcctcagtactatagtggatacataatacattttggtttagtaaaattaatacagccctcagcattgttcggatgcctgagacccatgtattgataggatttttttctgaggtaagaaaatgattaggatgtttgggatatcttctggttatgccgctcctctgacaacttgatgctatcacaaaggtagactgtcttgggaaatttttttgcattgttcttgaaataattaagttttacttgtgttgaaaccatttgctttattcatttgagctctcatgtgtccctttggccttccagtttcactaaggtgggttcttgagcattcggagttgggctcaggaacacaggcttaaactaatttgaaactaaggtagggattacagccttccaatctgttctttctaactctgatattatctacagtggtattaagtattgtgtggtgtggacagcctactaggctctgctgataatttcagcagcatcgtgtga

SEQ ID NO: 366985 - DNA, 675 bp, Homo sapiens
agcgggggggccaggaagccccaggcacacagtgccgcccttcagcgggggcctgggacacagagaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcctgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagt

SEQ ID NO: 366986 - DNA, 7979 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366987 - DNA, 8050 bp, Homo sapiens
  misc_feature (34)..(34): n is a, c, g, or t
  misc_feature (53)..(53): n is a, c, g, or t
caaaattgcttatttacatgtttactgttcctcnttttccattagaaacatcntgaatagtaaccagtatataataatcttttataacttttttttttgagacaaagtctcactctatcacccaggttggagtgcagtggtgctcactgcaacctctactggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366988 - DNA, 6765 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgctccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcactttaagaaataggatctgtggtgtattccaggggggcctgatggacacctttcccggggcgtcttgcagttgccctgcccgtgcccgcctgcagtggttggagacgggagtggccttcggtcccgagctccctctggggacggtgggtcactgtctccagttctcaatgggcaacgaagggtgttggga

SEQ ID NO: 366989 - DNA, 7955 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacaactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366990 - DNA, 5088 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctattttacaccaacccctgttcggttgagcggaga

SEQ ID NO: 366991 - DNA, 4921 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgcaa

SEQ ID NO: 366992 - DNA, 4822 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgcagcgtggccaatgcgcggcgcgcgcgggggacagagcaggaggcggtctgtcacctcggccacctgctgacctgggctggcctcccccagccctcccgtggcggagccggcagcgatgctacaggcctaagttattgtttgcataaaaagaatcatgttccctgtgtacatttaagaaaaaaacaaaaaaacggaaatgtcagaattgtatggaaataaaacttgtttgaaaatttggaatagt

SEQ ID NO: 366993 - DNA, 4589 bp, Homo sapiens
ctggactaggagcaggggaacatggcgccggggcccccgtcgttgctgccgggattttggaggccggggccgcgctgagggcgccagctggaagaaatgttggctatttggcgatgagaggtggtgaacagtgaccatactggtatacaacactatgggacctggcatttttgctgcatgtccagcccacccccactaataatgtaggaagctgtctggtccattggaaacactaatctgatctcagaagtggctgatcgtggcaggatgtgtcgacgatgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatggagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacagtgtcaccgaatgaaggaggcactgtccacagccccttttacagacaaggagactcaccctaaggtgtcacttgcccaaggtgacacggttgacgcgagaggccggatttgtaccagggccatctgagtcaggatctggactccagaccaccacaggaccttcctccctgctcagcgtgcccgtcattggcattctgtctgctcttccaagtctcactctcaccagggtgcttgtgcaactcccccaactctgaccctctgggtacgtcac

SEQ ID NO: 366994 - DNA, 866 bp, Homo sapiens
cggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggtgggcatcatggaccatacctggagcagctttgctataagaaatcagtttggggggcagggatgtcctcttttggatctttagtctccactctgtcccaggctagggctcacacatctgtccatgttctcctcagcatatcctccc

SEQ ID NO: 366995 - DNA, 307 bp, Homo sapiens
aggaggtggctcttgcggggcgggtaagaggaggattagggaacccacacctcaactgtccacttgacttgttggttgcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatccagagggtccgaggtgttt

SEQ ID NO: 366996 - DNA, 6611 bp, Homo sapiens
  misc_feature (2458)..(2458): n is a, c, g, or t
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 366997 - DNA, 6229 bp, Homo sapiens
  misc_feature (2076)..(2076): n is a, c, g, or t
cggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 366998 - DNA, 6540 bp, Homo sapiens
  misc_feature (2387)..(2387): n is a, c, g, or t
cggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 366999 - DNA, 5966 bp, Homo sapiens
  misc_feature (2458)..(2458): n is a, c, g, or t
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagcaggaggaggacagcagcaggaggaggacagcagcaggaggaggacagcagcaggagagacggc

SEQ ID NO: 367000 - DNA, 530 bp, Homo sapiens
atccccgaaatcaacctccgggacaaccaccctctgcagttcatggagttctccagccccatcccgaacgcagaggagctcaacatccgctttgcagagctggtggtcagtgagagggtggggagagacagtgacaatggggaggagggtggatggagaggcagagctggacagagggcagggcccctgtgctggggtctccatctctcaaaactcctcttgggaggagataggcccccaggacacctcagctatgttggggaaccagagtctctcactgggatggacagcataaagtgtgtccccagaagaatggtcctacctcctctctgcattggattgtagaccacatggtgcagtaattaggttatcataggaaggggcagctctgggttttgcaaaataagatggtgagacatctcaaagaacatcagaacatttgacgcctttctctcttctgctccttggagtttccctgggatcttttaatgtccgaggcacaaagaagggacagagtgggattctgtggg

SEQ ID NO: 367001 - DNA, 6281 bp, Homo sapiens
  misc_feature (2128)..(2128): n is a, c, g, or t
ggcgggggaaggagcatctcaggaaaggggtccccggactctggggctctcagcacctgcggtcgcaaaccaacctcatgccctgactttaccaggcgtcgggactctgacttaaccggggaatgagggacttggtctggcggcagatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367002 - DNA, 6435 bp, Homo sapiens
  misc_feature (2282)..(2282): n is a, c, g, or t
cggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367003 - DNA, 5531 bp, Homo sapiens
  misc_feature (14)..(14): n is a, c, g, or t
  misc_feature (22)..(22): n is a, c, g, or t
  misc_feature (25)..(25): n is a, c, g, or t
  misc_feature (1378)..(1378): n is a, c, g, or t
tagagcatccccgnctcatttnagntcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367004 - DNA, 6584 bp, Homo sapiens
  misc_feature (2458)..(2458): n is a, c, g, or t
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367005 - DNA, 5142 bp, Homo sapiens
  misc_feature (1016)..(1016): n is a, c, g, or t
gcctaagtggaactgctccggcctaagtggaactgctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367006 - DNA, 6399 bp, Homo sapiens
  misc_feature (2458)..(2458): n is a, c, g, or t
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367007 - DNA, 6418 bp, Homo sapiens
  misc_feature (2458)..(2458): n is a, c, g, or t
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctaattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367008 - DNA, 2021 bp, Homo sapiens
gtcaccgccattcttcacgtggtatcaacacttagggcacaagtttggtttggtgaaaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367009 - DNA, 4892 bp, Homo sapiens
  misc_feature (2458)..(2458): n is a, c, g, or t
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaanatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctattctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 367010 - DNA, 548 bp, Homo sapiens
ataaggtaaactaaaatttctggtactacagtaccagacttagtaaatgttaatctcttctttcactttcctcaggtcagtttggttgccctgttcttggaatgctccatgttttcctacacttttgccatcacccttctgaacggtttttcactcccagcacttctgacaccaaatgcggagggtggaggggctccctccacaccaaccaattttccagtaccaactgagtgtcctagaattcatttcaattctgatactaactacgcagagctagcctcagatgtgataggtttaagggctcattcccacaagactgccctcacatcagaggccagttgcaagtagcaggtttccaggttacccacaccttccgtcccacttgactacaaagttgggaattcccatgactctctactcaggttctataatttgctagcacgtctcacagaacctaggaaaacagtttacttacatgcactggtttattataaagaatacaactcagaaacagccaaacggaagaaatacatagagcaaggtatagg

SEQ ID NO: 367011 - DNA, 722 bp, Homo sapiens
atggctgaaggcgaaaggcacgtcttacagggtggcaggcaagagagaatgagagccaagagaaggggtttccccttttaaaaccatcagatctcatgagacttatttactatcataagaacagcacaggaaagacttgcccccatgattcaattacctcccaccgggtccctctcacgacacatgggaattgtgggagctacaattcaagatgagatttgggtggcgacacagtcaaaccatatcaatcattcttttaaaaagtaaaaatggtgttccatgagaaaagtaactagttcagttcacaaccctgaaagggtctcagactacagaatatgcagactacactttgggaaccactgctttatggtaaagaaaaattatcagtcaacttcaacatttgcagcaagaatagcatatcattttctggccaggtgcggtagctcacgcctgtagtcctgcactttgggaggccaaggcaggcagatcacttgagattaggagtttgagaccagcctggccaatatggtgaaaccccctctctactaaaaatacaaaaattagctgggcatggtggcgcacgcctgtaatcccagctactctgatggctgacgcatgaggatcacttgagcctggggggcagaggttgcaattagccaagattgtgccactgcactccagcctgagtgacaaggtgagacactgtctcaaaaaaaaaaaaa

SEQ ID NO: 367012 - DNA, 245 bp, Homo sapiens
gtttgcaagcatctggagctgagaagggtctccgcaggtcacgatagaagcctggcttgcacctctggcaatactgtccttctgtgttgtgctgacagtcatcacagacaccaccactacgattccctgatgcctcccacacattaacgtcgaagtgacagagacaacaaggagtccacagatgcgttgactttacaaagaaagcttttgagtatcgtgggcttgttacttacttctgcactcgt

SEQ ID NO: 367013 - DNA, 541 bp, Homo sapiens
gcccagttctgaagatgttgctacttcttgtgggtgaattatcaattcatttacagagaaagccacatacaaaacaagaggcagcccttcaggtcaggggagatgttctgaatcagcaaacagacataaaaagaactcttatcttaactatctcctgaaccttgcagttctcctgtaacagccagaacactttaataagactgggatattcttggagatgtggactgggcctaacttttatttctgatattccacctttaacctggacctccaagtttttctgtaaagtgagctgtgaaaaaagacaggctggagatccaagatttccttgtgctttcttatgaagtttggtgaagagcaatttaagagatattgtcaaggttggtgtgctgccccaaactctgcgactagaaaccaaaagtttctagggaactttttttcttttttttaaacttgaaggccttgctgaaatgctaccttctccattacactttacctaattcctttctctcctgtaacctctgagctaaaggtaatgtct

SEQ ID NO: 367014 - DNA, 372 bp, Homo sapiens
catatgtttgttggctgtttgtataccatctttttatgggtgcatagctttcttagctagctgttaagttcatcaagggtagaaatcatgcattttgcagctttgtgttccctgtaatatacagtagactgctatctctacagtaactactcaataaacattcagcacttttggaggctgaagcaggaggattgctggaagccaggagttcgaggctgcagtgagctacaatcatgccactatactccagcctaggtgacagaatgagacagtttctaaaaataaaactaaacaccacatgttctcacttataagcaggagctaaacaatgagaacacatggacacagggaggggacacagggacacacctg

SEQ ID NO: 367015 - DNA, 797 bp, Homo sapiens
tcagctgctagtgagcagcttcattttgtttgttagtatacaattcatttggaaatgtaaattttcaaaaatatcagaatagcaatatgaggtactgctagaatgtattatactaataactaaactaagaggaaagattttttgctgatgaggcaaaagttggtttctagtaactgtcctagaggcagcttaatactggtagaaaacatgggccttggagacactgggcatgaatcttagcctcactacttacagtctgtgtgatcttttgcaagttacctaaattttcggtgcccatttcattatctataaaattagtaaagctaactacctcctaggatggttgtgaagattaaattagttaatatagacgtaactcctaatacagagcatgacacttagtaaatcagaaatgttagtagcaattgttatttaaataaaacaataaaaaacccatgagtaattaactataaaaatcaactgataaaaaaattagctgacagaataagaacagtggttgtcagggaagggaggaagaatggggagttactgtttaatgggtatagagtttcagtggtatttgcaccaccatccatcaccagaactttttcatcatcacatactgaatgtacttaatgccactgaattgtacctaaaaatggttaaagtggtaaattttgcattatgtataatttgcacagtttgaaagaataatggacaaaataatgagctgacagtagatactaactggaaagaggtgatagtgttttaaggattgaaacaatataataaattac

SEQ ID NO: 367016 - DNA, 364 bp, Homo sapiens
acacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatatgtctgtatgtacctatatagacacatacatat

SEQ ID NO: 367017 - DNA, 1546 bp, Homo sapiens
aaatttttgatcatgggaattttgtcatgttcaatgaaaagtaatgttctgtcaaatgaaaataatgaggttcataaatgggaatatataagacaaaaatatgaatagccaaaatacgtttaaaaaatctaaactattgaacataaattaaattggttatccctgggaaaagatactgtatattttaatgatctctgtgtatttgggaactatagcagtaaatgcaaagatacatcttgcctgtctctcccggttttaagttaattgacacagatatttcaatagtagtattactcgttaaaattctgcaatacttattacctggtatcatttaaaaagatattttctctaagataaaagatactaatgaagatagaagacaccaatctgtttccatcctccttttctctcttgcattttcccttctgtgtattagaaacaataacaaaggcctgcttttatagtcttgacaaatcgtttcttacctgaaaggaacttgggttttctctttttaagctagctcttagtctgtagcttctgatagcaagtaatctcttcattctctagtatcctttgccatgacttaaaaatggagactatagcttaattgattgaatactctgacctagcagtcccatgtttgagtgcagggatggtgttgggcattttatcccctggtagtgatattctagaatgctttatgttcctaccccctaaaaaatcctccaaatccttcatattctcaagtagcacttataactttagcattattgcctaacacaacagttctaccattaatcatactacatgttcatccttctaaatgtcattatcaatttaggtagcctgtaagagtattgaatttaaggaaaagggtgaagggaagataaaaccatttatataaaagtgctgggtttcattgcttgtggtaaataatgttttaattttttgccaagtgaaaacaaatctttaaaaggaaaggaaaacaattattttatggaaatattttgtaaacatgtatgtaaagacattgttttctttgccaccaacaaattgttaataaaaaagtttttttttagtttcttcttgaatgaggttcctttgtgtatagtagggcaaattattcaggccttaaaaaaaaaatcttcaatctgagtttatttaatcagatgtcaacagaaaggttgcagcttcttccattttgttgttattttcaaccaatgtcttttccctctttttaagaaaaaagtcattgttttttaaatactatttttggatgaattatgtctgtagaatggttgaccaacagcatttgctaaactattgaaaaactaatgattggttggtcatctctatctatgatgtactttcattcatgaaaaccaatgagttctcatgataaataactcttggaaatagaaactctgcttactaacatgtacttgctgagggtaataatccggcattatacatacagtatgtgaggggaggggaattgcttatcctaacagtgttttcccgcattctcacacattgtactcatcat

SEQ ID NO: 367018 - DNA, 3320 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaacgacaaggtggttaaaatgtcctttagtagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367019 - DNA, 824 bp, Homo sapiens
cattgatgttcctccagcattttggcaatcttggtttctgtttggtcacttgttttacctttagagcattcagggaatagtctagagtgatttctaacattagcacaatcactatatatcacagttaattttgctaccaccatttacaagaatataggtaaaacattggtctctacccgctgggaatctaaaaaattgtatgtgctaagtgtcagtcacatggtcaacatgctgaagcacacccagctcaggttaaggtgctagatgaaccaggaaggagttaatactggctcttacttccagataatgcagaagggtgatgctgttctccagcactccatcagtgcaatctactggccaacgacaaggtggttaaaatgtcctttagtaggtatgaagacgtgatctgcttcttcagacacttatgcctgattagtgatgtagtttatgttagtgtctttgaaactgtaaataagtcaagtcaaatgtattaaattaagaacacagtctaactctgagtgtaagttttaaacccactcactatatggtaaatcttgcctttccttctcttatcaccaattttggaagtaagagaatcacagggttaagatgcttatatatatatatatttgactccagtcttgaagaaaaatacatgtaatcttatgctttattgcatacaatgaaaataaattttagatgtttatgttgttagatcagcgagagaaataaatgctttatgaccactttaaaaatatttaggaagtatataagattttaatagagaataatatctatcatacaaagtttataggataatttta

SEQ ID NO: 367020 - DNA, 3232 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367021 - DNA, 4123 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcctttgtaattatataataagatcaattatatatcttttattgttccatgtagtgagtgcttttgttgttgcagtttatacaactatgaagccgaaatgaatgagcattagaattaaaaaattaagaggcatgtacaggattcacagaactttatttggaattaacaagctgttcatagatcactaaatgttgtttcacaagcttatagaacatggattatctttgatgaattattgaaacgatttgcatgaagtttatgactgcgtacagtgtattttctctgcaggtaaacagtcttgagttaccacatggattaaaaaaaatctatgaatttttttgtaatcataacaaaatattagcataagccttattgtttacagagttttaatctttcacaccatttcctttaaaataatgagctgcatttcacatgtgagctaaaattgttgggcagcccactacacctattgaagcgagatatagtcagctctcacttccctgtttcgtactgggggaccagtggtacaaatcagcaataaaacagtgtatgatgtcatgctacatagtttggtcttcacagtggaagatattttgtgtggctgttgcatatgatttacatttcttaattaaatttactcaggttaataactgatttgtctgcatcctagaaacaaccagctctcagggtttaggtgtgggttggtctgagtagtaggagcagccaaactggaattaaaatgtttgctgtgagtagttcagaaaggcaatttttctgtgattatagagatgagtgcaactacacgtgatagctctgtcttcattcattttctttttgtggtgcaggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367022 - DNA, 3470 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaagagcttcctgcggctgagggagggatgaaacaagtacccatgtgaccaccaccactgggactgcgctggattagacctgaaaccagcatagcactgagtcttacccgggacctgtggcgaccactgcctggctaccactgatgttctctcaaggcccaagagctcttcagtcagcaggtagtgaatccggcctggcttgtatcctcccttcaggacagcgagctctccactggcccaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367023 - DNA, 4011 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcctttgtaattatataataagatcaattatatatcttttattgttccatgtagtgagtgcttttgttgttgcagtttatacaactatgaagccgaaatgaatgagcattagaattaaaaaattaagaggcatgtacaggattcacagaactttatttggaattaacaagctgttcatagatcactaaatgttgtttcacaagcttatagaacatggattatctttgatgaattattgaaacgatttgcatgaagtttatgactgcgtacagtgtattttctctgcaggtaaacagtcttgagttaccacatggattaaaaaaaatctatgaatttttttgtaatcataacaaaatattagcataagccttattgtttacagagttttaatctttcacaccatttcctttaaaataatgagctgcatttcacatgtgagctaaaattgttgggcagcccactacacctattgaagcgagatatagtcagctctcacttccctgtttcgtactgggggaccagtggtacaaatcagcaataaaacagtgtatgatgtcatgctacatagtttggtcttcacagtggaagatattttgtgtggctgttgcatatgatttacatttcttaattaaatttactcaggttaataactgatttgtctgcatcctagaaacaaccagctctcagggtttaggtgtgggttggtctgagtagtaggagcagccaaactggaattaaaatgtttgctgtgagtagttcagaaaggcaatttttctgtgattatagagatgagtgcaactacacgtgatagctctgtcttcattcattttctttttgtggtgcaggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367024 - DNA, 3314 bp, Homo sapiens
cttcaagaatttaaagaagactaacgttggctttatcatcttgacttttccatttctcaactttgcaaggataaaattggccactgttcttctaatacatgtggaatcctatatgatgtgcccagggacagcatatatagtggaaaagaacatagatgttggaatcacaagtgcttaatctttccaagttgctgtttcttcatctatgatatggaactaataatatgcacattcgtggggtgtgggaggaattaaaggacccaaagtatgtacagcatatatagtataggatgtctggctcagtgtgggtacttgcatagatgttaatttcttataccaaaaaccccaaatgaacctgaattgaatttaaagtgtggtgatgcattgatagtggtggtggtgatgtaggaattaagaattgtcatttacttttctttctagaattagtttggatgagttttgttcagtgagaaaatttcctgaaagaggtagacttctttaagagaaagaaaagtagtttacagaatgtagttgcagaaataatgtgaaagagagcacagattgaggagtaggaaaattaaatttagagtcccaactttgtggagtggcgtgaataaagggaagtgtacatatcactgaattcatgcttttccttaagttatctgttttcagagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367025 - DNA, 3395 bp, Homo sapiens
cttcaagaatttaaagaagactaacgttggctttatcatcttgacttttccatttctcaactttgcaaggataaaattggccactgttcttctaatacatgtggaatcctatatgatgtgcccagggacagcatatatagtggaaaagaacatagatgttggaatcacaagtgcttaatctttccaagttgctgtttcttcatctatgatatggaactaataatatgcacattcgtggggtgtgggaggaattaaaggacccaaagtatgtacagcatatatagtataggatgtctggctcagtgtgggtacttgcatagatgttaatttcttataccaaaaaccccaaatgaacctgaattgaatttaaagtgtggtgatgcattgatagtggtggtggtgatgtaggaattaagaattgtcatttacttttctttctagaattagtttggatgagttttgttcagtgagaaaatttcctgaaagaggtagacttctttaagagaaagaaaagtagtttacagaatgtagttgcagaaataatgtgaaagagagcacagattgaggagtaggaaaattaaatttagagtcccaactttgtggagtggcgtgaataaagggaagtgtacatatcactgaattcatgcttttccttaagttatctgttttcagagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367026 - DNA, 2406 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccata

SEQ ID NO: 367027 - DNA, 1886 bp, Homo sapiens
gagatcatcgtggatgttactccaaaacttcgtttaatgaatgcttaaagaattcaaattttatctgcctctcttgtaatttggagcctctcacatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367028 - DNA, 2183 bp, Homo sapiens
cattgatgttcctccagcattttggcaatcttggtttctgtttggtcacttgttttacctttagagcattcagggaatagtctagagtgatttctaacattagcacaatcactatatatcacagttaattttgctaccaccatttacaagaatataggtaaaacattggtctctacccgctgggaatctaaaaaattgtatgtgctaagtgtcagtcacatggtcaacatgctgaagcacacccagctcaggttaaggtgctagatgaaccaggaaggagttaatactggctcttacttccagataatgcagaagggtgatgctgttctccagcactccatcagtgcaatctactggccaacgacaaggtggttaaaatgtcctttagtagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367029 - DNA, 2852 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcctttgtaattatataataagatcaattatatatcttttattgttccatgtagtgagtgcttttgttgttgcagtttatacaactatgaagccgaaatgaatgagcattagaattaaaaaattaagaggcatgtacaggattcacagaactttatttggaattaacaagctgttcatagatcactaaatgttgtttcacaagcttatagaacatggattatctttgatgaattattgaaacgatttgcatgaagtttatgactgcgtacagtgtattttctctgcaggtaaacagtcttgagttaccacatggattaaaaaaaatctatgaatttttttgtaatcataacaaaatattagcataagccttattgtttacagagttttaatctttcacaccatttcctttaaaataatgagctgcatttcacatgtgagctaaaattgttgggcagcccactacacctattgaagcgagatatagtcagctctcacttccctgtttcgtactgggggaccagtggtacaaatcagcaataaaacagtgtatgatgtcatgctacatagtttggtcttcacagtggaagatattttgtgtggctgttgcatatgatttacatttcttaattaaatttactcaggttaataactgatttgtctgcatcctagaaacaaccagctctcagggtttaggtgtgggttggtctgagtagtaggagcagccaaactggaattaaaatgtttgctgtgagtagttcagaaaggcaatttttctgtgattatagagatgagtgcaactacacgtgatagctctgtcttcattcattttctttttgtggtgcaggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaacgacaaggtggttaaaatgtcctttagtaggtatgaagacgtgatctgcttcttcagacacttatgcctgattagtgatgtagtttatgttagtgtctttgaaactgtaaataagtcaagtcaaatgtattaaattaagaacacagtctaactctgagtgtaagttttaaacccactcactatatggtaaatcttgcctttccttctcttatcaccaattttggaagtaagagaatcacagggttaagatgcttatatatatatatatttgactccagtcttgaagaaaaatacatgtaatcttatgctttattgcatacaatgaaaataaattttagatgtttatgttgttagatcagcgagagaaataaatgctttatgaccactttaaaaatatttaggaagtatataagattttaatagagaataatatctatcatacaaagtttataggataatttta

SEQ ID NO: 367030 - DNA, 402 bp, Homo sapiens
tgattgtagatgtttttatatgggcttgggcttgtaagtgatcctcttgaatggcaccattttaccttctacaattgtttgattcctatctaattttataactttatttggattttaagtaatggataagctgcgctttactatgcagaatttgatagcttattttggtgtttgtctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtaatgaattttgatatctgctttcagtgacattactagaagtacatcct

SEQ ID NO: 367031 - DNA, 3313 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatgttaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaat

SEQ ID NO: 367032 - DNA, 2392 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttaccccggcctttgtgttaaggtgggatggtttttttttttaaaaaaagggtcccccccctcgtta

SEQ ID NO: 367033 - DNA, 1050 bp, Homo sapiens
acccagtccccctccccctcccctcgccggctagggtggtgcgtgccggcaggccggtcaaggaggcgggacacgtcggcgctaccaccgccaccgccgccgccgcccctcctcccgttccagctgccgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaatatttcctcctctgatgctcctcttcagcctttggtatcctctccttctctgcaagctgctgttgacaaaaataaattggagaaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgtttggagaaagattgagaaggaaaagagtgaaaggcagttagttgaagtggaagagttgaccttcatgtactgctttccaaaaaattgatcctagttgttattgaataaattgttgtctgttttaagaattata

SEQ ID NO: 367034 - DNA, 309 bp, Homo sapiens
tgagatggagtctcgctctgtcgcccaggctggagtacagtggtgcgagctcggctcactgcaagctccgcctcccgggttcacgccattctcctgcctcagcctcccgagtagctgggactacaggcactcgccaccacggccagctaattttttgtgttttttttagtagagacggagtttcaccgtgttagccagtttggtctcgatctcctgacttcgtgatccatttctcttaatctcagaaagccacactcggacatgctgcctatataatatccagaccaatgctacatagagttaaaggct

SEQ ID NO: 367035 - DNA, 171 bp, Homo sapiens
gaggtaaacagacaagatacacatatagttggcagattttaggggatagctgagctatagaaaatgacatactaatatgtgttatcattttttaaattggccctattgatgtaccctgcatgttaaacttatcctttctggcaggagcaggacctaatctactatcaaata

SEQ ID NO: 367036 - DNA, 301 bp, Homo sapiens
ggaatatctacctgtaggtttaatttaagggttaaatggaataatttatataaagcacctctgcatctgccccttagtcctaaataaacaactgcagatgatattgttggaaaagttgaggaagaaaagatatttgttatctattactgcataacaaaccaaaagcaacagtaaagatttatgacagtcacagtttctgtaggtcaggaatttgcagtggcttagtcgatagtcctggcccaaggcctcactcacatggctgacaggctggcgctccctgatgatggagaggcttcagttc

SEQ ID NO: 367037 - DNA, 912 bp, Homo sapiens
acccaacacacgcattcctggctacttaccaaggagaatagaaagcaggcagatctctacagcagctctctacctgattgcaaaacaatggaaatgcccacatgtccacaaacaagtgtgtggtctgcctgtgccatgaagcacagtgtggctgagcgtcaagagtccccacactcaaaggaggcagcagatacagggctgcacactgtgtgattccacacatgtgacattctggacacggacatgctggatggcaaaacgagcatcgggctgagaggactgctgagaaggggaacggggctgctgggatgtgggttgattgtagcagtagctcatggagatgtgacctcaaaagagtgatttttactatgtgcatactatacctccacaaacttgactttaaaaaaataaaatattcacagaaaaaaacaaaaacaaatgtaaaaccatcagactactttatcagaggtgttatttttagatagaggtctttgaactccatcctaggaacattgtacccatgtcctcccagaactgcatcttgcactgggtgtcggaagacagccctgcaagacctgtatgctctgtaccattcagtggtttttaaggttaactaccagaagtcatatctgaggcctcccagaagcattactctaaggaaagtagttaaatgtggacagtgacagcagaaacatttacacattaaaccagtttatagaacatgagaatgttcagagcataaagaagcttgtcagctcaatgacttacgaggcgtgggccattaaaaaaaaaggtctggagtttgggaaggagaaaggaatggggatgtgacctcaaaagagtgatttttactatgtgcatactatacctccacaaacttgactttaaaaaaataaaatattcacagaaaaa

SEQ ID NO: 367038 - DNA, 272 bp, Homo sapiens
aatgcagcggactcggcaggaggagatcagcaggctgatgcacatacagaaaaatgctgactgcacaagtttcagtgagctggtggagaactttaagaagaccttgagccacactgacccaatggtcttggatgattttggcactagcttacccttcatcgatatctacttttccactctggactaccaggacacaactgtccacaagcttcaagagctgtagtattagatcgtgcatgtgccgagtccgctgcattggggattctgttgtc

SEQ ID NO: 367039 - DNA, 755 bp, Homo sapiens
aatgcagcggactcggcaggaggagatcagcaggctgatgcacatacagaaaaatgctgactgcacaagtttcagtgagctggtggagaactttaagaagaccttgagccacactgacccaatggtcttggatgattttggcactagcttacccttcatcgatatctacttttccactctggactaccaggacacaactgtccacaagcttcaagagctgtactatgagatcgtgcatgtgctgagcctaatgctggaagacttgccccaggagaagccccagtccttggaaaaggtggatgagaagtagctgggcatggggcacccatgtgccgagagccttgcagaccatgacaggtccctattaaacacaggctttctgagttgtcctctccagagttgctgtgattatggcatttccccaccttttagagttgggcctggacaggtgctcatgaagtgtgattccccagagccaactccccgtcccccaccacaggacatgcagacctagggaatggggagagggaagctcaagacttgtcctggccagaggccagatccagggcccatgctggctctaggctccctggacctagcagcaaggacctggggaagctgcctgaggaccacagaccaagagggcctccagctaccccccaaagcacatggcccccttgagctggtgtggccctgttgatctgggtgtgggtgttctcatactgacagagtcacatctctctctgtgggcccac

SEQ ID NO: 367040 - DNA, 394 bp, Homo sapiens
aatgcagcggactcggcaggaggagatcagcaggctgatgcacatacagaaaaatgctgactgcacaagtttcagtgagctggtggagaactttaagaagaccttgagccacactgacccaatggtcttggatgattttggcactagcttacccttcatcgatatctacttttccactctggactaccaggacacaactgtccacaagcttcaagagctgtactatgagatcgtgcatgtgctgagcctaatgctggaagacttgccccaggagaagccccagtccttggaaaaggtggatgagaagtagctgggcatggggcacccatgtgccgagagccttgcagaccatgacaggtccctattaaacacaggctttctgagttgtcctctc

SEQ ID NO: 367041 - DNA, 2222 bp, Homo sapiens
cccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367042 - DNA, 2094 bp, Homo sapiens
  misc_feature (11)..(11): n is a, c, g, or t
cgcgggcctcngcacgagggggaaaccgactcccgggagcagggaggaacgcgcgctccagagacaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367043 - DNA, 2081 bp, Homo sapiens
cacgcagcggctagggcgcttagctgagccattgtctcgttctttccttcccaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367044 - DNA, 2047 bp, Homo sapiens
  misc_feature (1)..(1): n is a, c, g, or t
  misc_feature (14)..(15): n is a, c, g, or t
nataaaaatactannggctaggtacgaggctgggtggtcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367045 - DNA, 2841 bp, Homo sapiens
cccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacgtaagttcgagccctgattcctccgcttccccgcagggtgaccttgggcttgtgcccccggcaccacccctgtcccgggtccctgttttctctctggaaatgggttgaagaccaaagaaaataatgtgcgccacttgggtcaccccgggccgcctgccccggaaaattggccccagttgaggagttgtggctgtaaggatgccttgaaccgaggcggcggtgctcgtggttggagctctccagggtgggtgcgcatttgtaatgcggtggatgctctgggactcggcccctctgaaggtgcttgggggttggggacggcccaggcagcagtggcgtaggcgtcctaggaaggcgggagcagaggcagaaatgtcgctgcaagaccgtagtcagggtccttgaccacaggggtcacttgtgaccaagcacatggtctgttgttcctcctgccccctggttcagcccaggaaacactggtgctcaggtttggagccagagatttgcactgaaagggcgggattgagtcgccagttgtcagtttcctcagcagtattcgcggaggttttcacaggaggccgttgcttcgtaaatattatacatgtattctttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367046 - DNA, 2379 bp, Homo sapiens
cccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaaccccaggaaacactggtgctcaggtttggagccagagatttgcactgaaagggcgggattgagtcgccagttgtcagtttcctcagcagtattcgcggaggttttcacaggaggccgttgcttcgtaaatattatacatgtattctttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367047 - DNA, 2713 bp, Homo sapiens
  misc_feature (11)..(11): n is a, c, g, or t
cgcgggcctcngcacgagggggaaaccgactcccgggagcagggaggaacgcgcgctccagagacaacttcgcggtgtggtgaactctctgaggaaaaacgtaagttcgagccctgattcctccgcttccccgcagggtgaccttgggcttgtgcccccggcaccacccctgtcccgggtccctgttttctctctggaaatgggttgaagaccaaagaaaataatgtgcgccacttgggtcaccccgggccgcctgccccggaaaattggccccagttgaggagttgtggctgtaaggatgccttgaaccgaggcggcggtgctcgtggttggagctctccagggtgggtgcgcatttgtaatgcggtggatgctctgggactcggcccctctgaaggtgcttgggggttggggacggcccaggcagcagtggcgtaggcgtcctaggaaggcgggagcagaggcagaaatgtcgctgcaagaccgtagtcagggtccttgaccacaggggtcacttgtgaccaagcacatggtctgttgttcctcctgccccctggttcagcccaggaaacactggtgctcaggtttggagccagagatttgcactgaaagggcgggattgagtcgccagttgtcagtttcctcagcagtattcgcggaggttttcacaggaggccgttgcttcgtaaatattatacatgtattctttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367048 - DNA, 1949 bp, Homo sapiens
  misc_feature (1)..(1): n is a, c, g, or t
  misc_feature (14)..(15): n is a, c, g, or t
nataaaaatactannggctaggtacgaggctgggtggtcaacttcgcggtgtggtgaactctctgaggaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367049 - DNA, 2050 bp, Homo sapiens
aggggggaaaacgaattacggggctagtacgaggctgggtggtacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367050 - DNA, 2247 bp, Homo sapiens
  misc_feature (2226)..(2226): n is a, c, g, or t
cccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaanaaacacaaccgcagcaagaaa

SEQ ID NO: 367051 - DNA, 2073 bp, Homo sapiens
  misc_feature (11)..(11): n is a, c, g, or t
cgcgggcctcngcacgagggggaaaccgactcccgggagcagggaggaacgcgcgctccagagacaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367052 - DNA, 2201 bp, Homo sapiens
cccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367053 - DNA, 2060 bp, Homo sapiens
cacgcagcggctagggcgcttagctgagccattgtctcgttctttccttcccaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367054 - DNA, 2086 bp, Homo sapiens
ctactataggctaggtacgaggctgggtttgcacacgctcgggacacccacccgcttccaggcgtgactgtcaacagcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367055 - DNA, 2119 bp, Homo sapiens
aggggggaaaacgaattacggggctagtacgaggctgggtggtacttcgcggtgtggtgaactctctgaggaaaaacgaggccgttgcttcgtaaatattatacatgtattctttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367056 - DNA, 2179 bp, Homo sapiens
ctactataggctaggtacgaggctgggtttgcacacgctcgggacacccacccgcttccaggcgtgactgtcaacagcaacttcgcggtgtggtgaactctctgaggaaaaaccagtattcgcggaggttttcacaggaggccgttgcttcgtaaatattatacatgtattctttctttttggagcattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367057 - DNA, 2228 bp, Homo sapiens
aaaagcaccagtgggtgatcaggcccaggataggaatcatccctaagcagatccttaaatgccaaatataacttcaattttttgtgacggaaaatgtatttgtgcactgtgcctagcatggaaatagagaaaaactgagtctaattgataggcctgattgcatctcgctgaccagaatctctgtacctgagcagcttaggggcaagaaagaacagctgttttcttgaagtgtggaaacattagtaatacttaggaaggggctggccattggagattatgtttgtggtaaaggcctgacctgctgcttgtgaacagccccagtgtggaagaggacacctaaccataaagagaagggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagca

SEQ ID NO: 367058 - DNA, 796 bp, Homo sapiens
cccctagagggcctgggaggaagtgggttttgcatacagtccctgttgactctagtgccccctgctggccccagacgcgagttccggcgaggcttcagggtacagctcccccgcagccagaagccgggcctgcagcgcctcagcaccgctccgggacaccccacccgcttcccaggcgtgacctgtcaacagcaacttcgcggtgtggtgaactctctgaggaaaaacacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgaacaataaatggcctctcatgctaaa

SEQ ID NO: 367059 - DNA, 2045 bp, Homo sapiens
  misc_feature (520)..(520): n is a, c, g, or t
  misc_feature (574)..(574): n is a, c, g, or t
  misc_feature (600)..(600): n is a, c, g, or t
  misc_feature (1469)..(1469): n is a, c, g, or t
aagaccctgtctcaaaaaaaaaaaaaaaaagcactagccaaggctccatctcagacagccttctcttctcactctgcatgttctctaggagatttacatccctgtccatgacttcaggtaccacctatattgtatcaggcttttttggttcttagccccttcagactgctataacagaatgccatagtctgggtggcttttaaacaacagaaattcatatcccacagtcctggaggctgggaagtgcaagatcaaggtgcgggaagattcagtatctggtcaggacccaccagagaggtggttcatagacagctgtcttcttgctttcctcatatgatggaagaggcaaggcagctctcctgagtctctctcttttctttttgagatagggtttcactctgttgcccaagctggagtgcagtggtgtgatgatagctcactgtagccataaacccctgggctcaagtgatcctcccacctcagcctccctagtagcagactgcaggtgtgtgccatcacncctggctaattttttttattttttgtagggatgagattttgctatgttgcccangctggtcttgaactcctggcctcaancgatcctcctgccttggcctctcaaagcgctgggattataggcatgagtcactgcacctggccctgagtcttataagggcactaatcccattcatgagagctctgccctcatgacctgatcacctccccaaaggcccccacctccaaattccattacattgggggttaggtttcagtatatgaattcatggggaggacataaacattcagtctacagcaggtttattccaactacctcaagtgattgggagttatttcaaggatatataaggcacttggaaatctcataggaagctagaaacagccttccagctgggcctcctgttgtctcggatagggttcaggagtgagaagctcattgtgggtctgggacagttctagaactgcctcaccatcaccgtggccccgaaagtcttccatccctgccatgcttcacgtgccttcttgctgctttgtccacagccagcgcccacttcagattgccctcacagcttttatcagcctcctggcttctacgtttacttatatctttggtcttttacaaatgccttttatgtaaactttatgtaaagttgtatgcagagggtgagagccatagacgtgggcgatggccaaatcgcaatgggctttctgtgccacggaaggagtttgcacattatttagaaggcagtggggagacatgggtgagtttgaggccttacattagcatgtagtggatcactgtggctgcagaatgaaggagagggggcgaggcaggaacagaacctagttgggagttgctgcactttgggcaagagatggtaactcctgaaccagatctttggctgagacaatgagaggtgatgagagaggcgatgagccagatcttnggctaaggcgattagtcagaggcaagaagtccaggctggaagtataaggtgatgagacagactcaagaaataggattttaactcagtaagacctagggattgccttggtgcaggaatgaggtagggcactgccttccctgcagccctctctgatggagtcttttcatttgcttccacctgccatatctccattgtccctccattacatgtaaaacctcactggctctgaggctcccagcatctgctgcactacactccctgtagagtgcttaagagtgtggcttcttggccgggcacagtagctcatgcctgtaatcccagcactttgggaagctgaggcgggtggatcacctggggtcaggagttcgagaccagcctggctaacatggtgaaaccccgtctctgctaaaaatacaaaaattagccaggcgtggtggtgcatgcctgtaatcccagctactccagaggctgaagcaggagaattgcttgagcccaggagggctcaagtggagattgcagtgagccaagatagctctactgcactctagcctgggtgacagaacaagactgtgtctc

SEQ ID NO: 367060 - DNA, 1624 bp, Homo sapiens
aagaaaggtaattttaagctcctctccttcaaaaaagttcttatttgctaatagtgtgtatcagggaagggtcaaatccattaaaactctcccaagtggaacaagtgacctgaattacttgtttgcttaagtcaaacaggaaagttcttcttcctttgaactgaaataattccaggaaatgcaataaagaagctgagggagaaagaatgcatcgaggagagactgcttttccagcccaacctgtcacctacagtcttcacagctccacaagctctggcagtacctgttacgtacagtttatgtgcttgataatattcggaagaggtgttaaattcattcacgttctataccttgattgtcttctacaaactggcgttttttagttttttatgttggagagctttaacttttcaacatagcccactgaaataggagttgttttttttaagtacatgaaataacttttaagattgtacttgccatttatgatcaatccattctacattaagttcaaaatgttaagtagcaatgaatgttctatttataatttactttttcttccctttccaaatatctttccaggaaatgacccattcatggccgcctcctttgacagcaatacatacgcctagtacagctgagccatccaagtttcctttccctacaaaggtaattccttaaaagtatggcaggcattgcatccaccttagtgaaaagcgtaaggcattgctgtgaggcagattgataaagtattacttgttcaaatctttggaaatgaggttaaaattatgattaatttagcttctacagtgcttcagaatgctttcaaacatttattctgcaacttagaacatcctagattttcataaagctttataatttataaaaagcattcaggattttccaatacgttctctcatttgaggatccttactttagagatgggagaacagaggggcagggaaattgagtgtgtgatttctcgttcagaattagatatatgcacatacatcttacatatctcacactccctacattttcttgagtttaatgtgatcagttacactagtgctggtttaataacaagcaaataaactgctgacttgtgtgtttctgttacagtatttatgaacaatgcgttaaaacactgccattctccttttttttaatttatacttttggataaccttcaaaatgtagaaatagcaccttcagatctgtgttttgttcaatctgatatgcatgttcattgttttatatacataatacatatattgagagagtgagagagctattcctttccatgatactgttgtgaaaagtagttctaggccaggtatggtggctcatgcctgtattcccagtactttgggaggccgaggtgggtggatcacttgagtccaggagtttaagaccagcctgggcaatgtggcaaaactttgtctctccaaaaaaatacaaaaactagccaggtgtggtggcatgcacctgtagtcccagctacttgggaggctgaggtgggagaatcacttgagcccaggaggttgaggctgcagtgagctgtaattaagccactacactccagcctagacaacggtgagaccccgtctctctaccaccaaaa

SEQ ID NO: 367061 - DNA, 794 bp, Homo sapiens
ttggtgcacgttgcggggtgtgactcaccacggggaaatcagactgatttaaaaccttcagtgcaaacttgtaaattaaggcgaagacccagtgttccctgggacagttgcaaagtgagaagagctcagaaactgaagcacagaaacgttaggtaggagtctgagaggcgtggagaattttgcttgtgcaagattatttcagagcaaggtcgtgcggtgtgtgtagaagatgaacagactagccactttgcattgactggaaacaatggcatttacagaaagagtcaacagcagtggcaacagcctcccgagtagctgggactacaggcgcttgcctccacgcctggctaattttttgtatttttagtagagactgggtttcaccgtgttagccaggatggtctggatctcctgacctcgtgatccacccgcctcggcctcccaaggtgtcgggattacagacggagtctccttcactcagtgctcaatggtgcccaggctggagtgcagtggcgtgatctcggctcgctacaacctccacctcccagcagcctgccttggctcccaaagtgccgagattgcagcctctgcccggcgccaccccgtctgggaagtgaggagcgtctctgccaggccgcccatcgtctgggatgtgaggagcccttctgcctggctgccagtctggcaaagtgaggagcgtctctgcctggcgcattcccatcttgggaagtgaggagcgtctctgcccggcggccatccgcttgagatgtggggagcacctctgccttgccgcc

SEQ ID NO: 367062 - DNA, 765 bp, Homo sapiens
  misc_feature (712)..(712): n is a, c, g, or t
ttggtgcacgttgcggggtgtgactcaccacggggaaatcagactgatttaaaaccttcagtgcaaacttgtaaattaaggcgaagacccagtgttccctgggacagttgcaaagtgagaagagctcagaaactgaagcacagaaacgttaggtaggagtctgagaggcgtggagaattttgcttgtgcaagattatttcagagcaaggtcgtgcggtgtgtgtagaagatgaacagactagccactttgcattgactggaaacaatggcatttacagaaagagtcaacagcagtggcaacagtcattgagaacgggccatgatgacaatggcggttttgtggaatagaaaggggggaaaggtggggaaaagattgagaaatcggatggttgctgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgcttgttaaacagatgcttgaaggcagcatgctcgttaagagtcatcaccactccctaatctcaagtacccaggacacaaacactgcggaaggcgcagggtcctctgctaggaaaaccagagacctttgttcacttgtttatctngtgacttccctccactattgtcctgtgacctgcaaatccccctctgtgagaac

SEQ ID NO: 367063 - DNA, 564 bp, Homo sapiens
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaaggtgagcgcagccctgcgccacccagggctgggggtcgatccgcccggcccccgacgccgccgccgcggacttctcggaagccgaggctctccccgcctctctgccggcttcccagcacgctgactcaagtcgctggcgttcccacttttccggtgggagccctcggggagaacgggctagggctcagagctctcaccgccctacttgcgatcccgcggcaggtagcgcgtagaaaaacaggggacggggacatgggaagagacccatgctcctccctcacgcgcagcccccaagtcagacgtttgcctgtgcaccccgcgttttgcggagagct

SEQ ID NO: 367064 - DNA, 798 bp, Homo sapiens
aagaaaggtaattttaagctcctctccttcaaaaaagttcttatttgctaatagtgtgtatcagggaagggtcaaatccattaaaactctcccaagtggaacaagtgacctgaattacttgtttgcttaagtcaaacaggaaagttcttcttcctttgaactgaaataattccaggaaatgcaataaagaagctgagggagaaagaatgcatcgaggagagactgcttttccagcccaacctgtcacctacagtcttcacagctccacaagctctggcagtacctgttacgtacagtttatgtgcttgataatattcggaagaggtgttaaattcattcacgttctataccttgattgtcttctacaaactggcgttttttagttttttatgttggagagctttaacttttcaacatagcccactgaaataggagttgttttttttaagtacatgaaataacttttaagattgtacttgccatttatgatcaatccattctacattaagttcaaaatgttaagtagcaatgaatgttctatttataatttactttttcttccctttccaaatatctttccaggaaatgacccattcatggccgcctcctttgacagcaatacatacgcctagtacagctgagccatccaagtttcctttccctacaaagcagaactactccaatgaagtccattgtgttgaagagattcctgaaaggtgaagttccctggttaatctttctcatttgaagaaatatttaagtaggaagggcgtacatccatttactttcagtttaaag

SEQ ID NO: 367065 - DNA, 476 bp, Homo sapiens
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagaccttcttaagactgtgaactgtacctaggaatccaacttacaagggatgtgaaggacctcttcaaggagaattaaaaaccactgctcaaggaaataagagaggacacaaacaaatggaaaaacattccgtgctcatggataggaagaatcagtatcgtgaaaatggccata

SEQ ID NO: 367066 - DNA, 1486 bp, Homo sapiens
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaaaaccacctccggtcaataagcaggagaatgcaggcactttgaacatcctcagcactctctccaatggcaatagttctaagcaaaaaattccagcagatggagtccacaggat

SEQ ID NO: 367067 - DNA, 1248 bp, Homo sapiens
cctgcagcagacaacagcacagagctagatatgacggactttgttttccaagctgcagtaccaaagacattccagctgcagctcatgtctcctagcagcagcattgtcccagcatttttacacgggggaccatcacacaagtcattaaagttctgaaccctcagaagcaacagcttgcgaatgcggatcaagcttacatataatcacaaggggctcagcaatgcaagatctagcagaggtgtacaactttcccctcagtcctggcaatgagggtttggcaccattctcattccgtacttccccaccggtggggagtacgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaaaaccacctccggtcaataagcaggagaatgcaggcactttgaacatcctcagcactctctccaatggcaatagttctaagcaaaaaattccagcagatggagtccacaggat

SEQ ID NO: 367068 - DNA, 1485 bp, Homo sapiens
ttggtgcacgttgcggggtgtgactcaccacggggaaatcagactgatttaaaaccttcagtgcaaacttgtaaattaaggcgaagacccagtgttccctgggacagttgcaaagtgagaagagctcagaaactgaagcacagaaacgttaggtaggagtctgagaggcgtggagaattttgcttgtgcaagattatttcagagcaaggtcgtgcggtgtgtgtagaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaaaaccacctccggtcaataagcaggagaatgcaggcactttgaacatcctcagcactctctccaatggcaatagttctaagcaaaaaattccagcagatggagtccacaggat

SEQ ID NO: 367069 - DNA, 2412 bp, Homo sapiens
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggtaattccttaaaagtatggcaggcattgcatccaccttagtgaaaagcgtaaggcattgctgtgaggcagattgataaagtattacttgttcaaatctttggaaatgaggttaaaattatgattaatttagcttctacagtgcttcagaatgctttcaaacatttattctgcaacttagaacatcctagattttcataaagctttataatttataaaaagcattcaggattttccaatacgttctctcatttgaggatccttactttagagatgggagaacagaggggcagggaaattgagtgtgtgatttctcgttcagaattagatatatgcacatacatcttacatatctcacactccctacattttcttgagtttaatgtgatcagttacactagtgctggtttaataacaagcaaataaactgctgacttgtgtgtttctgttacagtatttatgaacaatgcgttaaaacactgccattctccttttttttaatttatacttttggataaccttcaaaatgtagaaatagcaccttcagatctgtgttttgttcaatctgatatgcatgttcattgttttatatacataatacatatattgagagagtgagagagctattcctttccatgatactgttgtgaaaagtagttctaggccaggtatggtggctcatgcctgtattcccagtactttgggaggccgaggtgggtggatcacttgagtccaggagtttaagaccagcctgggcaatgtggcaaaactttgtctctccaaaaaaatacaaaaactagccaggtgtggtggcatgcacctgtagtcccagctacttgggaggctgaggtgggagaatcacttgagcccaggaggttgaggctgcagtgagctgtaattaagccactacactccagcctagacaacggtgagaccccgtctctctaccaccaaaa

SEQ ID NO: 367070 - DNA, 449 bp, Homo sapiens
gaaacgttaggtaggagtctgagaggcgtggagaattttgcttgtgcaagattatttcagagcaaggtcgtgcggtgtgtgtagaaggtaggtggccgtgggttacctctctcagacctgcgtggtgttggcctctgggtggggataaaagtcacgaaaaagacctttggacccagagtctagttttttttctttggggccgaagaatacctaggcatggccctgtttcagtgtttacttcctctgtctaatgtatttccttagctcgcctttcatctttagtgggaaggattacttgagtggatattccggaagtagattcacaggagaatggaaaattctggatggtttgcttgctttaatttcaaggtgttgtctcttgtggatgttgggaagtattgtacttgaatatttgaagataaatatggagaaaagcagtggtgagaact

SEQ ID NO: 367071 - DNA, 737 bp, Homo sapiens
ggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgaggtgtgtggaatttcttatcttggggaattccaattcgaagacggatttgagatgaaaatgtccggaggatgtggggcaaggtggggaggttagtccatggcttttgggtagggggaattctttttggctttaggatcttgttaataacccgcgaaaaactcagatctgagatggacgactgattatagatattgaaatgcagtttgcagaaaggtttagagaacctttttatggagccaaaattt

SEQ ID NO: 367072 - DNA, 719 bp, Homo sapiens
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagatacttattgaagatctgctgtcagatgatgccttaaaatctgatagatcaaagatgacctatgggagagaatacgagaatagaaaaatgggagtccctgttctgtttaacctggcagataagcacacagccagattgtgaaacaatgtgataaacgctctagcagaagagcaaataaagtgttaaaggatcatagaaaacagcaaagtgtcacggatgaaatctttctaatgagaaccgtggaccttcttaagactgtgaactgtacctaggaatccaacttacaagggatgtgaaggacctcttcaaggagaattaaaaaccactgctcaaggaaataagagaggacacaaacaaatggaaaaacattccgtgctcatggataggaagaatcagtatcgtgaaaatggccata

SEQ ID NO: 367073 - DNA, 1324 bp, Homo sapiens
tcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaaaaccacctccggtcaataagcaggagaatgcaggcactttgaacatcctcagcactctctccaatggcaatagttctaagcaaaaaattccagcagatggagtccacaggat

SEQ ID NO: 367074 - DNA, 1481 bp, Homo sapiens
ctccggagtagctgggaatacaggcatgctccaccaagcccggctaattttgtatttttagtagagatggggtttctccatgttggtcaggatggtctcgaactccagacctcaggtgatcctcccgcctcggcctcccaaagtgctgggattacaggcgtgagccaccctgtccggctgaactgctatcaagttcttaaggctattgctgggagcagtaatttggtgacagatttaatatattaagagaaaatcccaggggtaaacatcttatctaaaggaactcaagcagacaaaggtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaaaaccacctccggtcaataagcaggagaatgcaggcactttgaacatcctcagcactctctccaatggcaatagttctaagcaaaaaattccagcagatggagtccacaggat

SEQ ID NO: 367075 - DNA, 1628 bp, Homo sapiens
  misc_feature (1616)..(1616): n is a, c, g, or t
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaancctctaaatcac

SEQ ID NO: 367076 - DNA, 1460 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367077 - DNA, 1481 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgtttgaaaaaaaaaacacaaaggcg

SEQ ID NO: 367078 - DNA, 1533 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgtttaaaaaataaataaaaacttgcggcacgaaggggggcccggtaccaatttgcccttaatggagcggtttacaaa

SEQ ID NO: 367079 - DNA, 1407 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcatgtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367080 - DNA, 1397 bp, Homo sapiens
tgggggacaggcagaaaatattcagatgcccccttcctggcacctgctctggagccaggctgggaggaatggaaaacccctgcggcctccctaacaggtgcagagggaaagggccccgacggtgacggatgggagtgtgcgccggccagggcctcaggcctttggagacgcagttttgctcttgttgcccaggctggagtccgatggcacgatctccgctcactgcaacccccacctcccgaattcaggcgattctcctgaatcctgaattctctgaactgggattacaggcatgcaccaccatgcccagctaattttgtactttttggtagagatggggtttctccatgttggtcaggctggtttcaaactcctgacctcgggtgatccactcgcctcagcctcccaaagtgctgggattacaggcgtgagccaccgggctttcccacactttgatgagcatcagaatggcctgaggagcttggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367081 - DNA, 1463 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggagatggttggatttctctgtcttcctgtgacctgactttctgtgtgtctgtttccctgataagtgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367082 - DNA, 1381 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctggatggttggatttctctgtcttcctgtgacctgactttctgtgtgtctgtttccctgataagtgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367083 - DNA, 1263 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggagaaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367084 - DNA, 792 bp, Homo sapiens
gacaaagctgatcaacatgcagctatcccccctgtcccagcttcccttaatgacttttgggcacactagagcaagtttaatacccctccatgctcattcatgggggtttctgcctacaggggaattgaaaactttatccgatttttaaaaattcactggctgccaggagctgctgggccccactcccctttccttggggtctgtgagctttggtctccagggatgagatgaggtagggtagggagggggtgcacttccttcctgaatctgggctccctgagctgctactgtcacccctcaggtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367085 - DNA, 660 bp, Homo sapiens
tcacagactcaccaaactcatactggccactgccctcctcgtgcttgtcctctggacccagttacacacctgtcccccctttcctgtggcagggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367086 - DNA, 1478 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgtttaaccctgccccaggcagg

SEQ ID NO: 367087 - DNA, 1378 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367088 - DNA, 1014 bp, Homo sapiens
cagacccacctttgagagggcacttcctactttctgttgtgtttggaatgcaaagatctggctgaaacggtggccacggagaaggggtgatagatttgagaggctggagggatgaggaagtgaggaactctacatactgagctctcaagcctaggagtgaaaacgggtcgttcagattctaggagataagtttccatgcactttggtggcacagaaaattgaccgtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367089 - DNA, 1337 bp, Homo sapiens
taagttcacagtcgagtggatcatagctggcgggtaaggctgaaggtgagatcaggatgagggtttggaagcccttgcctagaaggaggcagttttttgagacagcataggagagcgcaaacctccagggtcacagggctgcagtcttctcctttcggagaccccattgcagagaagagcgaaagcaggggcggggtgggggtgggagtggtctcttccggttcttgaagatagcgtcccttaggcaggaggggtgggtcactcagtctccaggctcgggaggcccccagcaaatcggacgctgtgggctaggccgccaccgcgagcccactcgcccgatacgcgccttggggtccgggtcggctttccccgggacccctggccggaaactgagccgttcacttccgccaccagccggaagttttctgtcactggacgccaaggagttttcggtggctcagctgggtaaccggggatcaccatggcggcctcattggtggggaagaagatcgtgtttgtaacggggaacgccaagaagctggaggaggtacaggggcccgtgctggttgaggacacttgtctgtgcttcaatgcccttggagggctccccggcccctacataaagtggtttctggagaagttaaagcctgaaggtctccaccagctcctggccgggttcgaggacaagtcagcctatgcgctctgcacgtttgcactcagcaccggggacccaagccagcccgtgcgcctgttcaggggccggacctcgggccggatcgtggcacccagaggctgccaggactttggctgggacccctgctttcagcctgatggatatgagcagacgtacgcagagatgcctaaggcggagaagaacgctgtctcccatcgcttccgggccctgctggagctgcaggagtactttggcagtttggcagcttgacttctgcagctggaggaggcccctcaggccggggatctggggagggctagcccaaaacctcccgcatcgggcaggcaccccctgaagtacttccttcagggtttcccctttgtgagggtgtcgagtagcctcaccggcctgtctggaggagcagctggctctgctctgagaaactctggcaagtggacgccattctcttgcccttaggattcactgctctctcctacagccgccaggcctggggtcctgaaaggaccttgggtggtaaagctgtacttggtgggagtgagggcgtggggaggaaccatgcaaatcgccttccatggtttttaaatgcagtaaataacatttctggatgagacttgtttccaaaataaaccagctatatctgttt

SEQ ID NO: 367090 - DNA, 414 bp, Homo sapiens
aagggaaatctacttgcccacaggaaatacgaaaccccaagcattcctagatataatgtatttccgcctttggagaaaaatatatccctcaaatacttcagtacaaaatacccacagtgaaaagttttaaaacatggtatgcttttaaacaaaatgagctccctgaagaagctgcagtatcctaagctcacacttgtttcttcttgaatttgtgatttagcagttttgggattaggcatcacgtgctttacaaagatgttgatctgtaattgctagtactgactcttttgctttcatgatggattatataccatttgcaattgatagtctctgaatctttattttctttgcaaaagtagcatgtcatctccaaaaaccggacagcagtgcttgctaaataaagtgtagtatcga

SEQ ID NO: 367091 - DNA, 452 bp, Homo sapiens
aagggaaatctacttgcccacaggaaatacgaaaccccaagcattcctagatataatgtatttccgcctttggagaaaaatatatccctcaaatacttcagtacaaaatacccacagtgaaaagttttaaaacatggtatgcttttaaacaaaatgagctccctgaagaagctgcagtatcctaagctcacacttgtttcttcttgaatttgtgatttagcagttttgggattaggcatcacgtgctttacaaagatgttgatctgtaattgctagtactgactcttttgctttcatgatggattatataccatttgcaattgatagtctctgaatctttattttctttgcaaaagtagcatgtcatctccaaaaaccggacagcagtgcttgctaaataaagtgtagtatcgatcaacgtgttaaactatcatgcctttcacaaaaaaaaa

SEQ ID NO: 367092 - DNA, 324 bp, Homo sapiens
gtgcctggcctggtggggtgcactgcccctgtggtccttctcacagctggccacatacccctcagatgcagtgagcggcccaccagacacctggcttacagagaacaggggtgaaggagagctgcaagccttctctcaaagcctcccttccttcctggtgtctgtgggctgagtgtgtctccctctggcttgattcatggtttttgctctctctttggtgcattcattctttccagattttttactttctttccattcgctcacaagggaagacctgctgagggcggaaacatcatgcatgagttaaaggagaacaatgggtga

SEQ ID NO: 367093 - DNA, 1040 bp, Homo sapiens
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgctgctgtctccagcgagtcattgcttctcttaatttatttacctggaatcaacttaatcctgtgtgttaggctgttcttgtgttgctataaagaagtacctgatcaggatctgggagaatttgaaaaaaaaagaaaaactagaaaaataaacaaatttaaaaggaaaaaaaatacctgagactgagtactataaagaaaagaggtttaattgactcacagttctgcagggtgtacagaaagcatggtgccagcatttgctcggattctgggga

SEQ ID NO: 367094 - DNA, 455 bp, Homo sapiens
tatctaatttactttcagcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttg

SEQ ID NO: 367095 - DNA, 270 bp, Homo sapiens
ggactggattattctgctgggtgacagtacacttagggaaaaaggtcaaggaagaaaagtccatcaggcatttttgttttaatttttaaaattcctgtttaacaatacagggtctcttgcaacgtgtgagctgcctcttgccaagagtgagtggcaaaagaaactaaccccggagcagttctacgtcacaagagaaaagggaacggaaccggtaagctaagctggtttacagttttctgattgcatgtgttggcagtgaggggccagttg

SEQ ID NO: 367096 - DNA, 1173 bp, Homo sapiens
  misc_feature (801)..(801): n is a, c, g, or t
  misc_feature (993)..(993): n is a, c, g, or t
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgaaaaaaaaaaaaaaaaaaaaaaaaaaaaaaaaanaaaaaagggggggggcctaaaaaataccccggggggccccaattacgggacccgagttttttggtaccacagggggccccctaaagggaggtgccggaattaaaaacgatagggcaggggggccgcgtacaaaaaacagtgctgtagtcgggaaaacacctgcttagtgggacaccttaggaaaagagagcncctactctcgtggggggggaacaaaattgggtgcacaaccatacctagcaagaggatttaaggctcccgagggaaattattaaatacaggtggtaatatggtggtacacaacggggaatagcgttcgtggtgagaaagttgtgggctgccggaatgtgattcagaaatattataccaggt

SEQ ID NO: 367097 - DNA, 801 bp, Homo sapiens
gcgtcgacggacgattccggggggactgactgtcgaataactgggcatgggatctggcagaggagagtgggaacggatcctgctgcctggaacaacacatcggggcacctcttggcatgttaatgacagtgtcattagcagctgtagtatcgtttatgtcttccacagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgctgctgtctccagcgagtcattgcttctcttaatttatttacctggaatcaacttaatcctgtgtgttaggctgttcttgtgttgctataaagaagtacctgatcaggatctgggagaatttgaaaaaaaaagaaaaactagaaaaataaacaaatttaaaaggaaaaaaaatacctgagactgagtactataaagaaaagaggtttaattgactcacagttctgcagggtgtacagaaagcatggtgccagcatttgctcggattctgggga

SEQ ID NO: 367098 - DNA, 1129 bp, Homo sapiens
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagatccttgttggatatccagaaagaagtctttagcatcaaaggatcaagaagtccttccacttcgagaggcaatggcttcgatagtgaagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgctgctgtctccagcgagtcattgcttctcttaatttatttacctggaatcaacttaatcctgtgtgttaggctgttcttgtgttgctataaagaagtacctgatcaggatctgggagaatttgaaaaaaaaagaaaaactagaaaaataaacaaatttaaaaggaaaaaaaatacctgagactgagtactataaagaaaagaggtttaattgactcacagttctgcagggtgtacagaaagcatggtgccagcatttgctcggattctgggga

SEQ ID NO: 367099 - DNA, 470 bp, Homo sapiens
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcaggtaggacgcgggtcccgcaggccccgccgccgcctacggctttcggcttcatttcaccggctgcacccgggagcctagggccggtccaggccgggcgctgccctcctactaagccctcctcggcgcgcccctccccccccccagcccgaggatctgggacagtggattgtaaacttggtggcggcagggtggggactgacccctgtgagaatccgaggaaatgaacaaatgatccccctaa

SEQ ID NO: 367100 - DNA, 767 bp, Homo sapiens
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttg

SEQ ID NO: 367101 - DNA, 619 bp, Homo sapiens
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttg

SEQ ID NO: 367102 - DNA, 1080 bp, Homo sapiens
  misc_feature (801)..(801): n is a, c, g, or t
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgaaaaaaaaaaaaaaaaaaaaaaaaaaaaaaaaanaaaaaaacagggggggcgccgccatcaaaaagataccccccgcgaggggcccccagaggtttaagcgggtaatcacccggtgttgttgtgtaaccagagggggtccccataaaggaggagcacgcgtagaatataacagccaacagcacgggcgccgccggtactaaacaccggcccgcgcagtgcgcaaacagcggcccagcgcgggcaaccctggggagaacagcaccctcactcgcgcgggggggccgcactctattggggacacactcgcttaag

SEQ ID NO: 367103 - DNA, 856 bp, Homo sapiens
agcggaggcgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagatccttgttggatatccagaaagaagtctttagcatcaaaggatcaagaagtccttccacttcgagaggcaatggcttcgatagtgaagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttg

SEQ ID NO: 367104 - DNA, 773 bp, Homo sapiens
tgaacctttgaagatcttttatggaatagagagtatatgataaaaactgtggtttggctattgaaaaaccaataatatctaccttcttctttgactacttatactattaaggctaaaaaaaccaaagtacctaatttctccagttcctttgcaactagtcaaaagtgctcaaggagggcttccctttatggaaaaaggcaaagtcttcttgagactttttaatcctttttgtccttttcaccctctaccttcttcctgcctagaatgtagaagcgaggcctggaggtgaagcagccatcttccattcatgccacagctagcatgagggtgaatgtctatataataaggatggcagagcagaaagatgaaaagagactggaactctggaagcagtttgaagccactgtacctacccctaccttgtaatggatgagacaaataaacccctatttgtttaagccactgtagtacagttctctgttatttacagatgaatgcattactgatataggttacatggtacaaagatcaaatttctcttctagaagataagttgacctgaggaaaagtcctgcaatgcacagagagaagccagtcagaaggctccaggaccccaggaaaaagacagtgaggccttgaaggatttagtatgagaaaaaggtaaattatcacaaatttttgtcatttgtaaattttttccataattcttatgatgaaaataattatataaccacacacttaccaaatattaaattaaaaattatttccagata

SEQ ID NO: 367105 - DNA, 335 bp, Homo sapiens
  misc_feature (27)..(27): n is a, c, g, or t
cgcggccgcgcgacacggctgcgagangacgacagagggctggaaaaatatccattgtccaagcggttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367106 - DNA, 1864 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367107 - DNA, 1964 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367108 - DNA, 1810 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367109 - DNA, 1789 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatg

SEQ ID NO: 367110 - DNA, 1819 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatgaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367111 - DNA, 2054 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaagaatgtagaagcgaggcctggaggtgaagcagccatcttccattcatgccacagctagcatgagggtgaatgtctatataataaggatggcagagcagaaagatgaaaagagactggaactctggaagcagtttgaagccactgtacctacccctaccttgtaatggatgagacaaataaacccctatttgtttaagccactgtagtacagttctctgttatttacagatgaatgcattactgatataggttacatggtacaaagatcaaatttctcttctagaagataagttgacctgaggaaaagtcctgcaatgcacagagagaagccagtcagaaggctccaggaccccaggaaaaagacagtgaggccttgaaggatttagtatgagaaaaaggtaaattatcacaaatttttgtcatttgtaaattttttccataattcttatgatgaaaataattatataaccacacacttaccaaatattaaattaaaaattatttccagata

SEQ ID NO: 367112 - DNA, 217 bp, Homo sapiens
ctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctaggtttgtaaaggcttttattatttcaactatacggaaacttatgtgt

SEQ ID NO: 367113 - DNA, 678 bp, Homo sapiens
gattgcatttggagatttcctgtatatctctatttgtctagttgtctttttaaaatatttttaacataagtaatacactaaggtgagtcacaaaatcttcagctagccttacaatatcagacatgttaaccatagttatagctagttcctgtgaagtaatattagcagcagttaatgttgacagggcttatttttccatttaacaggtgtgagcataagacttaggttttcttaggctcttaagcagaactacagcccagttatttctgtttatcttctttgttagtctttttctagttttttttctgttcctactgcaggaaagcatttgttggtaatttattcagtttcctttgccatgactttctttgatgtttttttccttattaggttattcgtttgtaagacagtaaacatgacttaattgaattaaattatatcttcattcttcatgcttagaaacctgtttatggaaaaagatggtctagttctgactggacattagatcctcaagaactggaaagtaaatttaattccaaaaccaaagctattatactaaatactccacataacccacttggcaaggtaagcaagtctcatctccttatacagtcttctgacctatcattttctcacatgttgaataattggctgtgctctttcctttattatgtgtag

SEQ ID NO: 367114 - DNA, 1041 bp, Homo sapiens
  misc_feature (849)..(849): n is a, c, g, or t
  misc_feature (851)..(852): n is a, c, g, or t
  misc_feature (856)..(856): n is a, c, g, or t
  misc_feature (861)..(861): n is a, c, g, or t
  misc_feature (870)..(870): n is a, c, g, or t
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggngnnttcnggaanagctaaaangtactccaggtggggcgaacaacaggcatcgggaaataggagcgaactgtgcaggccaatggaaattcagggaaaacgtatgtgacacttagaacgtaagtggaaaggggaagttttaaagagagaggcagaagcaggatccgctcaacttggtcacctggtattctgtgg

SEQ ID NO: 367115 - DNA, 1891 bp, Homo sapiens
cagctgctaccgctcggagtacgggatgatcgcggcggacacaccgtcatcgcgcgccctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367116 - DNA, 1790 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcgtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttta

SEQ ID NO: 367117 - DNA, 2275 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgactttaaaacaaaaaaagaaaaaaccaaaaaaaaaaaacaaaaaagaaaaaaaacagaaacaaagaaaaaaaacaagaaccgaacacaggacagggcagaaaaaaagggggggggcccaaaagataatgctcacagcagagggcaacaaaataatgccgccacaacaagatttgaacgaaaaaggagccccccacaaaagagaggacataacaacaaagggaggaggcaggcgtaaaaaacaggcagggagaggaaaaacacgtataggcgaatcactcgtggaagaacaccattctcgggggagagaaaaaagaggacaacaccccgccagagattagcgccagcgggataaacaagagagagataggggtacaacccggtcatacgcgagaaaaaaagggacgagaactatacaa

SEQ ID NO: 367118 - DNA, 425 bp, Homo sapiens
aaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctatgtatatgccatgaagccactgtcaccatcaacatgcagaacacttccatcgcccccaaaagattcctcaagttcctttgcagtccatccctcacgctgctgatttgtctttgtcaccatatattagttt

SEQ ID NO: 367119 - DNA, 329 bp, Homo sapiens
agttttcctgctcttcttttcgtggtccgaaagaaccagtaaatctacccttaggctggggcgcggttctcacgcttgtaatcccagcactttgggatgccgaggcgggcagaatgcttgagtccaggagttcgagaccagcctggatgacatggtaaaacctcatctccacaaaaaaatacaaaaattagctaggtgtggtagtgtgcacctgttatcccagctgaggtaggaggattgctagagcccaagagttgaggctgtagtgagccctgattgcaccacggcactccagcctgggcgacagagtaagaccctgtctaaaaaaa

SEQ ID NO: 367120 - DNA, 763 bp, Homo sapiens
gggtcttctggatccaaatgtgcatattttctcatttgttctcatagtctttttagaaagtttttagggctttcatcttttttctgttttatctaaaatgctcggggaagattctgagcacagggcactgactcctgaattcctttaattatcatttcccttatatctttcatgaatttttagtggactgtgtcgttatcccattgaggatcttgggtcgggaatttctggtctacaatgggaacgttttggctggataggtatttacgttcccaaactctcatagcagtcctgcaaatcaactgccttatatataatactccaatattacctgtaaagttgtcagatgtgtcataccggctcatacaagatcttttgtatcattttataaaacgatacaaaagctgcaaagccaccagcctgcctgcttcccttggagaagttgggacttcctgacaactgcacaaactcacgtgggggatttcaatatcccaaagcatgcagattcctggtgtggctggaattggtgctggggtgctgcgaaagccaggtttgaagcaggaagacaaaaaaaccactcacctgtgtcagcctcgagtgctgaagaacaaccgtgtgtgggccttcaaccctgtctgggtgggttctggacagtgggtggggacccggcgggagaagggaaaggtcgttgagggggcagggcatgaaaactgtcgctggagctgggcaagagggtggaggctgctttggaagctgggcctgg

SEQ ID NO: 367121 - DNA, 407 bp, Homo sapiens
aatgacagcaatgacagccttttcttgaatccgttagtaattgactgaacccttgcccctggcttaggggactcagaaataaactagatggctgaggtccctggccttgtggagcgttgttctagtaacggaaacagttataagtgagcaaaaacgtaacttggggtagttataagtaccagacagaaaaaaaggaaagcataaagagttaaaggatgcttgcaggagaggggagctgcttttctagctggctgccttgcccctgtgtctctgggctgcctgccattcctgcaatccagcatggctcagtatcataatcctcttttataaacgaaaataaggatctcaaagaggcttaaagacctctccatagtcactcagctatgaagcacagagctggggtttgg

SEQ ID NO: 367122 - DNA, 4605 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367123 - DNA, 1205 bp, Homo sapiens
cgaaggaatcttttttttttgtgcaggaaataaagtcctttttgcgggggattattcagaacagccccgtcagtcaaaaaggagtgtaaccctcctgtagggcattcccaatttcccctaactttttcaaccttcgctctgcgtgtgggaatgtgccgataacaaaaggggggaaataaccctttgcccctacccgtgcccccttttttcgaaaccaattggcctttggaaggtatggccccatccccccggtctacgcagggggcacttggtgtttttttgtgcttgtcccaattaaaaaccggcgaagagtgttccgcacaccttaaaaaaagtgcccaagagggtttccgtatgggggtagaggatttttttttctgtaaaagcccgggtgtaagaatctttgtagtttgcgggtgttttgttattttcaggttttgaagcagcccgggcaaaaaggcagctgtgtataaggtatcactgtttaagaacccggacggccaattgagaaaaaagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctgg

SEQ ID NO: 367124 - DNA, 3555 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctgg

SEQ ID NO: 367125 - DNA, 4527 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaagtggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367126 - DNA, 2715 bp, Homo sapiens
agctgtaatagaggaaacagacatgaccagggaagagattaggtatgagcatttgtgcattgaacaagattgcagagcacgctctttctttttccagttttgtttttagatacagtctaatttgagattgttagcccgcatttcattacagtgctagtatagtttgtacttacattgtgctcaaaaatatctgaataggagctttacctaaaacatttgttcggctaattggaattgaaagccattgtgtttatatatttttttctcaatgaaaaggatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367127 - DNA, 1869 bp, Homo sapiens
acccattggatggatgaatgtttgacggggaagaggaagggtaggaggatgcatggatgagtggatgagtgtcttctcccctgacaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367128 - DNA, 2255 bp, Homo sapiens
cgaaggaatcttttttttttgtgcaggaaataaagtcctttttgcgggggattattcagaacagccccgtcagtcaaaaaggagtgtaaccctcctgtagggcattcccaatttcccctaactttttcaaccttcgctctgcgtgtgggaatgtgccgataacaaaaggggggaaataaccctttgcccctacccgtgcccccttttttcgaaaccaattggcctttggaaggtatggccccatccccccggtctacgcagggggcacttggtgtttttttgtgcttgtcccaattaaaaaccggcgaagagtgttccgcacaccttaaaaaaagtgcccaagagggtttccgtatgggggtagaggatttttttttctgtaaaagcccgggtgtaagaatctttgtagtttgcgggtgttttgttattttcaggttttgaagcagcccgggcaaaaaggcagctgtgtataaggtatcactgtttaagaacccggacggccaattgagaaaaaagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367129 - DNA, 2343 bp, Homo sapiens
  misc_feature (2293)..(2293): n is a, c, g, or t
  misc_feature (2306)..(2306): n is a, c, g, or t
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagntttgggattacanttttggttttcttttttgggaaaatttgggctgtttt

SEQ ID NO: 367130 - DNA, 2179 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataatgtcctgtaagaatttgaagtaaaaaaagagaaaggaaaaaggagacaacaccaaggtgtctttcgcattcagtcacccaggctggagtgcaatggtgtggtcagagctcgctgca

SEQ ID NO: 367131 - DNA, 1689 bp, Homo sapiens
  misc_feature (1609)..(1609): n is a, c, g, or t
  misc_feature (1654)..(1654): n is a, c, g, or t
  misc_feature (1657)..(1657): n is a, c, g, or t
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaagaatggtaaaaagngaattattctgacacctgatgctggtgaatgaggcagcgctatgngantaagcaaagttgggtcatctggtatatagcag

SEQ ID NO: 367132 - DNA, 376 bp, Homo sapiens
ttttttgtgtgtatgtatgtgacaattagaagtaagagacatcttaggatctagcaaagtgaagtgcctggcattctcaataaatactgttgatggaaatatttagttaaaaccttttatgctaattaggattgatacatttagtgatgtttgctcaggatgcaatggtataccagaaggttcctctctaaacgtgagattttatagtgtttctttttataacctcagtttatggtacaaatttaacataaactgtaactttcacatgcttccttccagatgctgcagtctgaagagacttccagcacctctcagttgaatgaattaatgatggcttctgagtcaactttactggctcaggaaccacgagagatga

SEQ ID NO: 367133 - DNA, 4551 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctcccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367134 - DNA, 3782 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaacaatccaaccctacttaagaacatcacccaccctcacaaacaaaaaaaacatgtcggcccgcttggccaaatcgattctagattcgagcaagtttatgcatgctgcccgcaattcgagctaactgtgccaattgcccctataggggtccgattacaattaacttggcgcggtttacaacggctgcattggaaaaccctggggttcccactttaaacgctttggag

SEQ ID NO: 367135 - DNA, 2203 bp, Homo sapiens
gatcctctgcacacgccgcatacccaaactgtacgaacacagatctccttgttaatgacgtacacacggcggaggctgtagaagcagacctcgttgagacactgtttgcaaggcctgtgtatggagattcggcgtgtgcatgcacacgccgaaacccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatacttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaactttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatc

SEQ ID NO: 367136 - DNA, 2383 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagtaagtatttatgcctgaaccaacctgctgagtacctgccagtgtgtgaagcactatgctgagtactacagagatgataaggcaccactcttgattgcttacagtgtcctgtaagaatttgaagtaaaaaaagagaaaggaaaaaggagacaacaccaaggtgtcttgtgagtgtgatgcagatcataactctttgaagaaaaagtcagcattgactggagtagttgggggaacttatgtagttctttgttgttgttgtttttttttttttttttgaaaaaggaacttcagcctgggcgacagagcaagactccgtctca

SEQ ID NO: 367137 - DNA, 1718 bp, Homo sapiens
cccttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaagaattgttaaaaaaggtgaaatttattctcttgatatacactcaatatggccgcctgtccatcatttcaaccatgccattcagtgctgatccaggaatatttcacctttttaacaattcctca

SEQ ID NO: 367138 - DNA, 1126 bp, Homo sapiens
  misc_feature (687)..(687): n is a, c, g, or t
  misc_feature (689)..(689): n is a, c, g, or t
  misc_feature (692)..(693): n is a, c, g, or t
  misc_feature (702)..(702): n is a, c, g, or t
  misc_feature (704)..(704): n is a, c, g, or t
  misc_feature (709)..(709): n is a, c, g, or t
  misc_feature (714)..(714): n is a, c, g, or t
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaananaannaaaaaaaancncgaanaaagnacacacactctagggcactttgggcattccaatccccctaatttcccactataaagcctatcaggcactaggaactcaccctccggggacagacgccttgggaccaaagacccctccgagcctaattgccccacgagattcctattccccacaagggtatttttggccacagagtggccacagtaccatcccaaaaaaccttgcacattagtctagcgaggtggaaaatttccggaaatttatgtgcgcccaccgcggtccctccccgtggatacacggtctgcagattggggcagtttagaggggtaacccccgtgtgtaaaagccctgtgatgttgagacaaaaactttcccccgtggaggagccccccgtgtatgcaggcgcggagggagtacggcttaaacccccggt

SEQ ID NO: 367139 - DNA, 417 bp, Homo sapiens
aggatctcactctgtccctcaggctagagttcagtggtataatctgagctcactgcaaccttcgcctcctgagctcaaccaatcttcctaccgcagcctgggcaacatggcgaaacctgtctacaaaaaaaatacaaaaattcaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367140 - DNA, 267 bp, Homo sapiens
tagaggatcccccaattcctccagtcgtacagatggtgtcacggtcacctgcaaagtggagcatgagagcttcgaggaaccagccctgatacctgtgaccctctctgtacgctgtgagtgtatcgggggtgacccctcccccatcaaaactgcctacactggcttctctaaagcactgtctacattgtctctgaatgttgtctacgtgggttccctgaagccaaattctgcactaccttcctgccattgtctacactggctcccatg

SEQ ID NO: 367141 - DNA, 2436 bp, Homo sapiens
  misc_feature (1997)..(1997): n is a, c, g, or t
  misc_feature (1999)..(1999): n is a, c, g, or t
  misc_feature (2002)..(2003): n is a, c, g, or t
  misc_feature (2012)..(2012): n is a, c, g, or t
  misc_feature (2014)..(2014): n is a, c, g, or t
  misc_feature (2019)..(2019): n is a, c, g, or t
  misc_feature (2024)..(2024): n is a, c, g, or t
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaananaannaaaaaaaancncgaanaaagnacacacactctagggcactttgggcattccaatccccctaatttcccactataaagcctatcaggcactaggaactcaccctccggggacagacgccttgggaccaaagacccctccgagcctaattgccccacgagattcctattccccacaagggtatttttggccacagagtggccacagtaccatcccaaaaaaccttgcacattagtctagcgaggtggaaaatttccggaaatttatgtgcgcccaccgcggtccctccccgtggatacacggtctgcagattggggcagtttagaggggtaacccccgtgtgtaaaagccctgtgatgttgagacaaaaactttcccccgtggaggagccccccgtgtatgcaggcgcggagggagtacggcttaaacccccggt

SEQ ID NO: 367142 - DNA, 2488 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367143 - DNA, 2346 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagacctactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367144 - DNA, 2106 bp, Homo sapiens
  misc_feature (1667)..(1667): n is a, c, g, or t
  misc_feature (1669)..(1669): n is a, c, g, or t
  misc_feature (1672)..(1673): n is a, c, g, or t
  misc_feature (1682)..(1682): n is a, c, g, or t
  misc_feature (1684)..(1684): n is a, c, g, or t
  misc_feature (1689)..(1689): n is a, c, g, or t
  misc_feature (1694)..(1694): n is a, c, g, or t
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaananaannaaaaaaaancncgaanaaagnacacacactctagggcactttgggcattccaatccccctaatttcccactataaagcctatcaggcactaggaactcaccctccggggacagacgccttgggaccaaagacccctccgagcctaattgccccacgagattcctattccccacaagggtatttttggccacagagtggccacagtaccatcccaaaaaaccttgcacattagtctagcgaggtggaaaatttccggaaatttatgtgcgcccaccgcggtccctccccgtggatacacggtctgcagattggggcagtttagaggggtaacccccgtgtgtaaaagccctgtgatgttgagacaaaaactttcccccgtggaggagccccccgtgtatgcaggcgcggagggagtacggcttaaacccccggt

SEQ ID NO: 367145 - DNA, 1655 bp, Homo sapiens
  misc_feature (1216)..(1216): n is a, c, g, or t
  misc_feature (1218)..(1218): n is a, c, g, or t
  misc_feature (1221)..(1222): n is a, c, g, or t
  misc_feature (1231)..(1231): n is a, c, g, or t
  misc_feature (1233)..(1233): n is a, c, g, or t
  misc_feature (1238)..(1238): n is a, c, g, or t
  misc_feature (1243)..(1243): n is a, c, g, or t
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagtgcatggggagcccggggagctgagtagtggggatccagagaggacccccgcccccagagacttggttttggctccagccttcccctggccccgtgacactcaggagttaataaatgccttggaggaaaacaaananaannaaaaaaaancncgaanaaagnacacacactctagggcactttgggcattccaatccccctaatttcccactataaagcctatcaggcactaggaactcaccctccggggacagacgccttgggaccaaagacccctccgagcctaattgccccacgagattcctattccccacaagggtatttttggccacagagtggccacagtaccatcccaaaaaaccttgcacattagtctagcgaggtggaaaatttccggaaatttatgtgcgcccaccgcggtccctccccgtggatacacggtctgcagattggggcagtttagaggggtaacccccgtgtgtaaaagccctgtgatgttgagacaaaaactttcccccgtggaggagccccccgtgtatgcaggcgcggagggagtacggcttaaacccccggt

SEQ ID NO: 367146 - DNA, 1315 bp, Homo sapiens
ggaggatgcgactctgcggtggtctaggatgactctgacctggtggtgagcttgctcctactcgccactgaacccgatagcgtagctggaggcacatgagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367147 - DNA, 887 bp, Homo sapiens
tgagcggtcccggttatgtcagggcagtgtatgtatgcagctggctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367148 - DNA, 1273 bp, Homo sapiens
  misc_feature (834)..(834): n is a, c, g, or t
  misc_feature (836)..(836): n is a, c, g, or t
  misc_feature (839)..(840): n is a, c, g, or t
  misc_feature (849)..(849): n is a, c, g, or t
  misc_feature (851)..(851): n is a, c, g, or t
  misc_feature (856)..(856): n is a, c, g, or t
  misc_feature (861)..(861): n is a, c, g, or t
gaggctgggtttgaatcggccgaggcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaananaannaaaaaaaancncgaanaaagnacacacactctagggcactttgggcattccaatccccctaatttcccactataaagcctatcaggcactaggaactcaccctccggggacagacgccttgggaccaaagacccctccgagcctaattgccccacgagattcctattccccacaagggtatttttggccacagagtggccacagtaccatcccaaaaaaccttgcacattagtctagcgaggtggaaaatttccggaaatttatgtgcgcccaccgcggtccctccccgtggatacacggtctgcagattggggcagtttagaggggtaacccccgtgtgtaaaagccctgtgatgttgagacaaaaactttcccccgtggaggagccccccgtgtatgcaggcgcggagggagtacggcttaaacccccggt

SEQ ID NO: 367149 - DNA, 1111 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcggttttttttggcctgggcccagtcacccctccacagggcccatacaatagagcccctggagccagactagcaccataccatagaacgtcagaagactacggcacagccagacagcgaaccagcatgcatagtgcgccatgatagcctagcattgactagcatagacatcccataggaaatatcccagagaagacccacaaggggatagctagacggaggtttacaaaggttgacattatcgctcagtatgtgttgacagcacgggccccaacgacttcagagaggaggacaaccgatagtgaaggaaatagacaacgatgaacacaaccacttgacataggcacaacacatagataacgcttgagcaacataggttaacatttacgtcgccacatgggatgcagcacgttggagctaagacagaaccaacaagagaaattggccaaccacagttgcagcacaagcaccataccccaaggaaacactggtttgcgacccaggcaccagttgttacgcgcaacacccggatcatcatcacactttgaggagggttccccaccaagaacatttaccaccacaaccaagagcgagcccgacaaggacaccattacgaacagcaagcccgggacaagcaccgcatgacattagagatcacccatattacacaagtcacaaccatttggcaccacaacatggtacaactggcaacgaccacagcccattggcaacagaccatcgaatcgaaacccgatccgcaatggcaaggggtacccacagaaaagcacattcccaagcagggcaaaacgggccaccagaacaggaccaattgcgtaacgcccaagtataccgcaaacacagaagtcgaacccattcgaaacccaaggcggataggaagaaacgagagaaaccagg

SEQ ID NO: 367150 - DNA, 2708 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367151 - DNA, 2557 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagagaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367152 - DNA, 2502 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaaaaaaaagcct

SEQ ID NO: 367153 - DNA, 2068 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagtggggatccaaaaaggacccccgcccccaaaaacttggttttggctccagccttcccctggccccgtgacactcaggagctcataaatgccttggagga

SEQ ID NO: 367154 - DNA, 1755 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcagaaatgctcgatacatgagctgccccttggagaggtcggacctgccctggggcccagctgggtccccctccgtgctccgggcctggtggggacgttcttgtttagatgggggggggggaatttggatccctttttttgcttgcctgtttcggagtgttgtcgcttttgtcctg

SEQ ID NO: 367155 - DNA, 1489 bp, Homo sapiens
ggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgaggtgagtgggtcttgggggccgtgtgtggagacctgggtccgctcccctggagttctgcccttcaggacttggggctgcactgggggaggctgcgccgccgacctgggagggatgcagacctgcctggctgaggggagatgagggttggccttcccctcgtggcctcagactggggtctggatttggggtgtcggggtaggtgaaggcagca

SEQ ID NO: 367156 - DNA, 1262 bp, Homo sapiens
  misc_feature (823)..(823): n is a, c, g, or t
  misc_feature (825)..(825): n is a, c, g, or t
  misc_feature (828)..(829): n is a, c, g, or t
  misc_feature (838)..(838): n is a, c, g, or t
  misc_feature (840)..(840): n is a, c, g, or t
  misc_feature (845)..(845): n is a, c, g, or t
  misc_feature (850)..(850): n is a, c, g, or t
cgctaggtacgagctggggttaatcggcaccgaggtacacttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaananaannaaaaaaaancncgaanaaagnacacacactctagggcactttgggcattccaatccccctaatttcccactataaagcctatcaggcactaggaactcaccctccggggacagacgccttgggaccaaagacccctccgagcctaattgccccacgagattcctattccccacaagggtatttttggccacagagtggccacagtaccatcccaaaaaaccttgcacattagtctagcgaggtggaaaatttccggaaatttatgtgcgcccaccgcggtccctccccgtggatacacggtctgcagattggggcagtttagaggggtaacccccgtgtgtaaaagccctgtgatgttgagacaaaaactttcccccgtggaggagccccccgtgtatgcaggcgcggagggagtacggcttaaacccccggt

SEQ ID NO: 367157 - DNA, 1134 bp, Homo sapiens
gcggcccaggcccggaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgctcgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaac

SEQ ID NO: 367158 - DNA, 2086 bp, Homo sapiens
  misc_feature (14)..(14): n is a, c, g, or t
  misc_feature (16)..(16): n is a, c, g, or t
  misc_feature (19)..(19): n is a, c, g, or t
  misc_feature (24)..(24): n is a, c, g, or t
  misc_feature (27)..(27): n is a, c, g, or t
  misc_feature (56)..(56): n is a, c, g, or t
agacaactcttgtngnganacccnaanatttgaaaacaccggtttgtggtgttaanaaaaaaaaggcagctgtacgcgaatccggatcgatgtcacaatcatgtcatatgcttgtgatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtctttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcaaaaaaag

SEQ ID NO: 367159 - DNA, 1559 bp, Homo sapiens
gcggcccaggcccggaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgctcgggctggagccggggcgcgacgtggacctggggcagctggagcaggagagctgtctggatggctgggagttcagtcaggacgtctacctgtccaccattgtgaccgagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctgtgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaggatcgcctgagcccaggagttcaagaccagtttaggcaacatggtggaaccctgtgtctac

SEQ ID NO: 367160 - DNA, 1019 bp, Homo sapiens
ctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaggatcgcctgagcccaggagttcaagaccagtttaggcaacatggtggaaccctgtgtctac

SEQ ID NO: 367161 - DNA, 256 bp, Homo sapiens
ttgtccttgtaggcatgggccagatctccaactatgtggcagcatttgtcctgggtatggccatcaggttggagttgagtacttgatcctgtatttcaccatcatcccatcacctacctttctggagacagctgtgatgtccctcaagggggacagggtttctaacaaaactagccagagcttcctggtgaaccttacttacaggcagggaaactgagccagacatgagaccagcctggggtccccagcagcacaa

SEQ ID NO: 367162 - DNA, 150 bp, Homo sapiens
ggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcc

SEQ ID NO: 367163 - DNA, 3244 bp, Homo sapiens
gcggcccaggcccggaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgctcgggctggagccggggcgcgacgtggacctggggcagctggagcaggagagctgtctggatggctgggagttcagtcaggacgtctacctgtccaccattgtgaccgagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctgtgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtctttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcaaaaaaag

SEQ ID NO: 367164 - DNA, 3316 bp, Homo sapiens
gcggcccaggcccggaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgctcgggctggagccggggcgcgacgtggacctggggcagctggagcaggagagctgtctggatggctgggagttcagtcaggacgtctacctgtccaccattgtgaccgagcaagacagtggggcctacaatgctatgaaaaacaggatgggaaagaagcctgctctctgccttcctgcccagtggaacctggtgtgtgaggacgactggaaggccccactcacaatctccttgttcttcgtgggtgtgctgttgggctccttcatttcagggcagctgtcagacaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctggggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctgtgcgtggcactctggtggttcatccctgagtccccccgatggctcatctctcagggacgatttgaagaggcagaggtgatcatccgcaaggctgccaaagccaatgggattgttgtgccttccactatctttgacccgagtgagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtctttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcaaaaaaag

SEQ ID NO: 367165 - DNA, 2704 bp, Homo sapiens
ctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtgcctacgaccgcttcctgccctacattctcatgggaagtctgaccatcctgacagccatcctcaccttgtttctcccagagagcttcggtaccccactcccagacaccattgaccagatgctaagagtcaaaggaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtctttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcaaaaaaag

SEQ ID NO: 367166 - DNA, 3450 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367167 - DNA, 1109 bp, Homo sapiens
tatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccagaactccatccgccacaacctttccctgcacgacatgtttgtccgggagacgtctgccaatggcaaggtctccttctggaccattcaccccagtgccaaccgctacttgacattggaccaggtgtttaaggtgaatgccctgctttcctctaaatagggcctaagttggaggttgtcatagccatctcaaaaggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaattctgggaatgcttgctctaaaaaaagcccttcctgctgggtgtggtggctcacgtctgtaatcccagcactttgggaggctgaggcaggtggatcacctaaggtcgggagttggagaccagcctgaccaacatggagaaactccgtctctactaaaaatacaaaaattagctgggtgtggtggcgcatgcctgtaatcccagctacttgggaggctgaggcaggagaatcccttgaacccaggaggcggtggttgtggagagctgaaatcgcaccattgcactccagcctgggcaataagagtgaaagtctgtctc

SEQ ID NO: 367168 - DNA, 3228 bp, Homo sapiens
  misc_feature (27)..(27): n is a, c, g, or t
ggacgcgtgggtcgacccacgcgtcgngctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367169 - DNA, 3530 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaaaaaaaacaaaaccacacgccccaaccgccaacga

SEQ ID NO: 367170 - DNA, 2656 bp, Homo sapiens
tatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367171 - DNA, 3556 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcagccacccacctgcccactcatcacagttttggagactgctcgcctacgtccatcccctcagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367172 - DNA, 3484 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtttttggggaacaggtggtgtttggttacatgagtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367173 - DNA, 2829 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccagggagcactaagcgcttagtgctcccttgtaaaccagtgccgggcagacactgggtagaggcggttggccag

SEQ ID NO: 367174 - DNA, 2749 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcactgaccgcatgggtgtgagccagcttgagaacactaactactcaataaaagcgaaggtgga

SEQ ID NO: 367175 - DNA, 2620 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctctcagtgcaccccaagcctctgagtgaggacagcaggcagggactgttctgctcctcatagctccctgctgcctgattatgcaaaagtagcatgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367176 - DNA, 1303 bp, Homo sapiens
  misc_feature (77)..(77): n is a, c, g, or t
tcctcagttcagaaccctttgcggtgattcaagggggggagcactttgcaagggagtggtgctcccccttgaatccnaagcatccatcaagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367177 - DNA, 1114 bp, Homo sapiens
  misc_feature (10)..(11): n is a, c, g, or t
taggctaggnncgaggctggggttgagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367178 - DNA, 1948 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaaggtgaatgccctgctttcctctaaatagggcctaagttggaggttgtcatagccatctcaaaaggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaattctgggaatgcttgctctaaaaaaagcccttcctgctgggtgtggtggctcacgtctgtaatcccagcactttgggaggctgaggcaggtggatcacctaaggtcgggagttggagaccagcctgaccaacatggagaaactccgtctctactaaaaatacaaaaattagctgggtgtggtggcgcatgcctgtaatcccagctacttgggaggctgaggcaggagaatcccttgaacccaggaggcggtggttgtggagagctgaaatcgcaccattgcactccagcctgggcaataagagtgaaagtctgtctc

SEQ ID NO: 367179 - DNA, 1348 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaaggtaatgtgtcccacagcaaccaaaatcaaggtcagcccagcctgacagtctctccagtgctgtactgcaacttgtatctgggacagcagttaagtgcaaaggacactagaatgataaacaaatgtatcttttagattgtgactcaatcttattgaatccaggcaaaatcattaagaagagctccttaactacttcatgtgttactacctaaagtccatggagggtcttcaatgtagcactcaagcccacttt

SEQ ID NO: 367180 - DNA, 430 bp, Homo sapiens
ataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggagctgggctctgtggtttattggcgtctgattcctaaggcaccaggagaggctggaaaagaaagagggtgttgatggagacgatggtgatagggaagaggcaaggcctgaagttcacccaaagcagcagttggagcacttgcacaggcacacacttgacaacacaaattgccagttttcccagtgctagtcctgcacagctcacctcttttccctggcgtctctgaccttg

SEQ ID NO: 367181 - DNA, 3495 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367182 - DNA, 3609 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtttttggggaacaggtggtgtttggttacatgagtaagttctttagtggcgatctgcgagattttggtacacccatcaccagcttgtttaattttatctttctttgtttatcagtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367183 - DNA, 2866 bp, Homo sapiens
  misc_feature (27)..(27): n is a, c, g, or t
ggacgcgtgggtcgacccacgcgtcgntgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367184 - DNA, 4431 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaaaaaaaaaaaagggggcgccaaagttccctcgagggccaagtacgggaccgtttggacagggcccaaggagcaaaaaaaagaaggcgggaacagccgccggaccgcccggctcggagaccctcgggggatgcgcccacgatagccggttaaacgacgtacgctggtggtgtgacttctcagcagtacaccacgagcgcacaaacacaacaaacaacacacacagcgcacacaccacacaaccaccaaccaagaaccagaacaacacgagcacacacaacaacacacaagaacaacaacgagaaacgacagagggaaggagagggaggcgaagagggaggacggccagcgagggaagccagagcagcagcgaaaggggagagcgggaggaacgacgagaggagaggaacggaggaagaggagcggagggaacggaaggaagcgaagaagacgaagaagacaaaagggacagaggcacggagaacagaaaacagcagcgaacggagaggagagaagagaaaaagcaagccgaagaagacaagagacaagcggacacgacaaaagcagagacagaagaacacagagcgagcgagacaagcacacgcaaagagaagaaaaggggaggaggagacaaggaaagaaggcgagaccggagagagaaaaagcaagaacaaggagaaacagatgacgagcagaagcgagaaagacagacaagcaacaggaaaccggacgcaagaagacagaaggagaagagccaacaagacggaagccaggacagaccgagagaaacgaacaagaccacagcgccggaagagaaccacgaagagggaggaggaaaaggaggaagagagcaagggaaaggaccaacgaatgagaacgaagcggaagaagaacaataacgaccgacacgaggaagaaccagaacaaagcgagacgaa

SEQ ID NO: 367185 - DNA, 4099 bp, Homo sapiens
  misc_feature (3924)..(3924): n is a, c, g, or t
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggaaaaaaaaaaaaaaaaaaaaaaaaaaaaaaaaaaaaaaaaaaaaaaaaaaaaaaaaaagggggggggcgaaaaaccccccggggggggccacacaataaatgctctgaaagcccgctgtttttttgcgtaagaagagggcgcccccaaaggggcggtgcatacattaaaacggaagagcagagcgcgcagattataaacaaagggctgacggggggaaagcaacggcaagtggacgacccttggggaggcaccccacatggcgggggagacaaaaaagcggacaacatcaccagaaatatacgaacggagaaataacagaagatggtaacggggggctacaccacagccaaatatgtgcggggagaaaaatgggccgccggggactaatgtgtgcgaacaatttaccgacgctcggtcttatacaagcgngagagaggtaccacaccaaatgacaggcagagcgagagctgcccgacacgagaaacgacaccacaataatcgatagacaataacaaacagagcacagaacacacgtcgagcaccaaacacagcacgagagagaagaaagggccacaccctcgacgagaagagggcacccagccaa

SEQ ID NO: 367186 - DNA, 3024 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcatcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtgga

SEQ ID NO: 367187 - DNA, 2294 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacgaacgtgcatttcctcaccgagaattgtctcccagaacctgatctggggttacgccccgcaaataggggctgtttcagccagtcaaccccagggcttgacctgtttgcccgggtgggtcagccatctggatggccctgtacgaaggtctggactaacttcggcttggatccgattatcaccggcggcagtgttaaccttcaggggatacgctgttgggggggagataaagcaccctagggtgt

SEQ ID NO: 367188 - DNA, 2042 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagcagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgggtgtcctattttcctctgaagagagattctggccaattaagaatgttggaccttcagcttgcaaagcactctgataagtgttccttgagagcttataaatctagttgggtagaaaaggcataaaaacatagggaagtgtaatagcattagaagagctaaaaaggtatttggattacaatgtaagtggtgtcagaaggcccataaatacctgatgagcttgtaagaattcagacaaaagtgattgtgatagatgggctaggattattaaggaagatacacaagggaggcaggccttagaaagagatggatttggccgggcgctgtggcttacacctgtaatcccagcactttgggaggccaaggcaggtggatcatgaggtcaggagtttgagaccagcctggccaacgtggcgaaaccccgtctctactaaaaaatacaaaaattagctgggcttggtggcacatgcctgtaatcccagctacttgggaggctgaggctggagaatcacatgagcccaggaagggaagttgcagtgagccgagatcactgcactccagcctgggtga

SEQ ID NO: 367189 - DNA, 1280 bp, Homo sapiens
gccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactgacccaggtctccacaatgccccgcacagaagggatcctctagaacgacc

SEQ ID NO: 367190 - DNA, 507 bp, Homo sapiens
gattttaagacttcaaaacgacacaaagaggatcagaacccgtatgtgatatttttgtgcgtcctgtctggtgaccgttggttcaccttatctctgtttccctttcaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtg

SEQ ID NO: 367191 - DNA, 458 bp, Homo sapiens
caacctactctctctctcctcggaatctgacctcaactgcaccctttctgttccacttcacttctcctcaattctgacagcttgcagtgaccttccctagctacaaagagaaaactgtgttgggtttcatttgcaaaattctcaagtagaatccatcacaccttcagtcctgttctctaagggcccttttagcagtcacattattgccctcttattattggcagagagagtctgagtgaccttggatgaatctcaactgctttttgagcttaaccttgacagcccctcggtttcattacctaatgatttaggaatatcagactatctagaaaatcttttaagattacttccatttctaataacctgctcatattccttatctcagtgaaatgaccctaccaggtacttaaatcccaaaagtcacatggaaatcctctctctcactcatcctcatattc

SEQ ID NO: 367192 - DNA, 628 bp, Homo sapiens
taatttactgagcacccactaagcattgcaaattgctatctcattttatgcttcccaggaagaatgtgaagaattattctccccatgttagagatgagaaaactgagactaaaagactgacccaaagccacatagctagaaaatggacaagccaggattcaaagtcagatttgcctgacctcaaaattcatgtttctttttcactataattccttgaactaggtccttcacagctgggcctaggggacagttgggtgggaaagctcgatgtgaaccactttgacacccacagtgggactaggcactcccagagaaaggccagtccaggacctgggcccgttgtgtgctgtgtctgtgggtcctgccaccgattcatcctcctccctgaactttctaaaatcattcttgagacttttaaatgttttattgaggtgcaagtttacaatgacagcaaacctttcaaaccacagcaagagtaacctgcctccttggcatattaaaaaataatgttagtgtcggtttttacatcccatagtttggattgctgataagagtgcttccttgacaagattatttttgaggtttacagaaagcgtaataaaatatgtaagttacatttccacaaaca

SEQ ID NO: 367193 - DNA, 1733 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367194 - DNA, 1020 bp, Homo sapiens
  misc_feature (879)..(879): n is a, c, g, or t
  misc_feature (881)..(881): n is a, c, g, or t
  misc_feature (905)..(905): n is a, c, g, or t
  misc_feature (909)..(909): n is a, c, g, or t
  misc_feature (926)..(926): n is a, c, g, or t
  misc_feature (933)..(935): n is a, c, g, or t
  misc_feature (942)..(942): n is a, c, g, or t
  misc_feature (944)..(944): n is a, c, g, or t
  misc_feature (954)..(954): n is a, c, g, or t
  misc_feature (972)..(972): n is a, c, g, or t
  misc_feature (975)..(976): n is a, c, g, or t
  misc_feature (983)..(984): n is a, c, g, or t
  misc_feature (990)..(990): n is a, c, g, or t
  misc_feature (994)..(994): n is a, c, g, or t
caacttaggctaggtacgaggctgggtggctggctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacatcattttgttggccctcttgtgcccccccncnttcttacccccggtttggggctgngaancctttttggtggtttgnttgtttnnncccgggntncttataggcnggctttttttcaaaaaanccnnttttggnnggaacncttncccctttaggacgcttgtaataaagt

SEQ ID NO: 367195 - DNA, 432 bp, Homo sapiens
aaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367196 - DNA, 749 bp, Homo sapiens
tggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcacacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagt

SEQ ID NO: 367197 - DNA, 1678 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367198 - DNA, 1697 bp, Homo sapiens
aacttcggctaaggtacgaggctggtgttgggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367199 - DNA, 1994 bp, Homo sapiens
aacttcggctaaggtacgaggctggtgttgggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttaaatctagtgtctttatttcttctgttacaatagtgttgcttgtgtaagcaggttagagtgcacagtgtccccaattgttcctggcactgcaaaaccaaattaaacaatcccacaaagaattctgacatcaatgtgttttcctcagtcaggtctatttcaagattctagaagttccttttgtaaaacttgcctttaaaactcttcctcctaatgccatcagatctcttaacattggctcactgtgggatctttcctcttaggttgaatttctacgtgaatatcaaagtgcctttttc

SEQ ID NO: 367200 - DNA, 2078 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaggtcatgttcaatttcttcaaagttttaacataaaaataatgagagccaggagtggggccggggcctggggggacgaaggtggtatgtgaacaaggttggcacacaggcctcaccctcctctgcctcagattcccaagtgggcaggtgggggtgaatggggctccgggtagcacctcagctcctctcagctcccctcagcctgttctccttccagacccagagagctgagaagagtagctgtgaggctcagggcagaggctctctgcctttcaggaacagccctaaccctgctccccttgcttggcctcaggaaggtgccgcgagctctcctgccgtccctgggccgccctgggctctgctgtgtccagatggtcaggctactgccagctggggc

SEQ ID NO: 367201 - DNA, 1683 bp, Homo sapiens
  misc_feature (1506)..(1506): n is a, c, g, or t
  misc_feature (1508)..(1509): n is a, c, g, or t
  misc_feature (1511)..(1511): n is a, c, g, or t
  misc_feature (1520)..(1520): n is a, c, g, or t
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacatcntnntntgggccagnctggcccacaacctcctacctcccagttggggagagaaccataggggggtgggtagaccaggggaaaagttaaaggagcttgttcaaaaaacggcttcgggaagaatgttcctttagaaggctgatagacttgtcctcggagagaggccctcttgattttccc

SEQ ID NO: 367202 - DNA, 1231 bp, Homo sapiens
ctctgtgctgatggacacagccccccacctacctcttggccttctgttccctgaggtaggtggggggctctgtgctgatggacacagccttgtactcctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367203 - DNA, 1112 bp, Homo sapiens
gctgttctgaggatacccgactgctgagcgaatacgaacactgtgagagttcgtggccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367204 - DNA, 2019 bp, Homo sapiens
gagcggctgagagccgtggagagggtgctcggggtcatctgccttgtcttctcctggccctgtccccctgagagagctttccaggtctccaccctcccaagctcccagcgctgtcctttcctccttccttccttccatcattcctccttccctccctcccatcctaccccctcctccttttccttctgtcttccttccctctatctcctcttcccatccctagttgactgtccccttctcccttagagtggccaccccttttctgcagcatccctgcccctttccctgtctgtttcccagcgcattcatgcctggcactcagctcacttttctctgtcttccatctacctcccaaggtcactgggggcctttcgcagccctctccatgctcccagacgcccttaggtgtcctgtgtcctccagctccatttcaccaacctgcctgccggactcttccctctttatcttcccaaagtactccattgcttggaatcctcctgggactccctcagggcagtggccagtttgcatagcctgagggaagaactgtgggtgcttcgacacccgctagctttgcagcatccctgaccactgctcctcacggaatctgtgctctgtggtctgtttgtacgtcctcagcagttcctccattcacctgccttggccttgctagaatatttcctcttctggaaatgcccttctcctttcccatagccttccatgaaagtcctgccaaatttcaggcttaaatatcccttcacaggatgtctgggtgttgttccaacactgcccaggtcgattctattgcagacagactggtgcttgttatttatggccccaactgtccccattagaccgtggccccgggacccctgctagcctcgtctgctgcctcagctgttagctgacaagcggccatcttccccagatgggtttgcagaagcctgctgtgcagagagagaggctgaaaatttgcatacctagggctccggccccctcgctgactgttgcttccatttcactttcagctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367205 - DNA, 1482 bp, Homo sapiens
  misc_feature (1439)..(1439): n is a, c, g, or t
  misc_feature (1475)..(1475): n is a, c, g, or t
  misc_feature (1478)..(1478): n is a, c, g, or t
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactanccactgtggaagagaggaagaaaatagtgcatcgtnacnttgt

SEQ ID NO: 367206 - DNA, 1021 bp, Homo sapiens
  misc_feature (33)..(33): n is a, c, g, or t
caacccttacggctaggtacgaggctgtgtgtncaattcagtacatggtccagtattacgcgtcatcagtgcgaggtgcacgatccccaatacgactggatgtgagatcgatgttcgcgaagctgatagactcctaacttctgggacattgaattagaatttaattgatatccttgaactgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367207 - DNA, 1050 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatggtacaaggcagtcgggcttggctgggcctggccccaacccctgtgtgttacgtgggaacagtcccgtttcctgccagctgcctgtcaggcagattctggacctgacacgcaggacatcggggcatagttttggagggtgtgggctctgggttcagtcctggttctgttgctgttcactgtggattgggcctgtgaactttggactctttccccatactgaggttgggtggcccaa

SEQ ID NO: 367208 - DNA, 831 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagggctagtaacagtttttaaataaaaggcaacaggtcatgttcaatttctt

SEQ ID NO: 367209 - DNA, 1105 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagctttgatgaccatgacccagctgtgatccatgagaacgcatctcagcccgaggtgctggtccccatccggctggacatggagatcgatgggcagaagctgcgagacgccttcacctggaacatgaatggtacaaggcagtcgggcttggctgggcctggccccaacccctgtgtgttacgtgggaacagtcccgtttcctgccagctgcctgtcaggcagattctggacctgacacgcaggacatcggggcatagttttggagggtgtgggctctgggttcagtcctggttctgttgctgttcactgtggattgggcctgtgaactttggactctttccccatactgaggttgggtggcccaa

SEQ ID NO: 367210 - DNA, 850 bp, Homo sapiens
tggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367211 - DNA, 850 bp, Homo sapiens
aacttcggctaaggtacgaggctggtgttgggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagggctagtaacagtttttaaataaaaggcaacaggtcatgttcaatttctt

SEQ ID NO: 367212 - DNA, 1307 bp, Homo sapiens
ccttgatgtgctgcatccacttggctggctgctgtgtgccaccgccaccagcagagtgacccagtgatgtttgtctgttacagatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagcacgtttcagttccttcctccccagaaaaacactctgctttgaccttgtgctccccacaacgccacagtacctcctcgcctttgaactgttgtgtttccctgacttccaggacattgtccatagcctccttggctctgtctgctgtcaccttgccatgtcctcctcacctctctggcccctcaagtggagttactcagggcgcggtccttgggccctttctctgccctcagtttcacatgagtgggccacagccagtctgatggtgcagatgccatccacgtgactcccactgtgccaccatttcccagagcctgctggagtaaaccaccacaaactggtggcttcgagcagagcacatttcttccctcacagttctggggcccaggagcctggatttagtttcactagaccagactcatgtgtggacagggccatgctccctccagaggccatcgaggcgattcggtccttgcttcttccagctttgggggctgccacgttccagtctcagcctctgtggtcacgtggccttctctgcatgaaacttccctgtctctctcttagaaggacacttggcgatgtaatttagggcccttctggttaatctctcaggatctttcacttaatcgtatcttcaaagtctccttttttggccatatgagctgacagtcacaggttttggggattaagttgtagatgtcttcggggtctgttttttacctctgtggcccagacttcctcagctgccctcaccccctcagcctcatgctgcctgaagacctctccatctcggcgcgtggagatccagccctctccttgctcaggctgtaggtttctttcccaaggcctgccttttcctcacacagcaagtccagtctctgccaggttctcccctgggac

SEQ ID NO: 367213 - DNA, 1670 bp, Homo sapiens
aacttcggctaaggtacgaggctggtgttgggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367214 - DNA, 1672 bp, Homo sapiens
cagatgtcccatcgctgtagtctctctggataagacccttggtggccagtgaggcacttcgccggagctcctgcagattgtggacctcggtggccatgatccgggggcgctcggaggctgtcgcggggccttgtacgcgtacaaggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367215 - DNA, 1647 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccagcgacctcctagctcccattctggtaaaaactttagtgttttggtgtagaccggcagggctagtaacagtttttaaataaaaggcaacaggtcatgttcaatttctt

SEQ ID NO: 367216 - DNA, 1674 bp, Homo sapiens
  misc_feature (1533)..(1533): n is a, c, g, or t
  misc_feature (1535)..(1535): n is a, c, g, or t
  misc_feature (1559)..(1559): n is a, c, g, or t
  misc_feature (1563)..(1563): n is a, c, g, or t
  misc_feature (1580)..(1580): n is a, c, g, or t
  misc_feature (1587)..(1589): n is a, c, g, or t
  misc_feature (1596)..(1596): n is a, c, g, or t
  misc_feature (1598)..(1598): n is a, c, g, or t
  misc_feature (1608)..(1608): n is a, c, g, or t
  misc_feature (1626)..(1626): n is a, c, g, or t
  misc_feature (1629)..(1630): n is a, c, g, or t
  misc_feature (1637)..(1638): n is a, c, g, or t
  misc_feature (1644)..(1644): n is a, c, g, or t
  misc_feature (1648)..(1648): n is a, c, g, or t
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacatcattttgttggccctcttgtgcccccccncnttcttacccccggtttggggctgngaancctttttggtggtttgnttgtttnnncccgggntncttataggcnggctttttttcaaaaaanccnnttttggnnggaacncttncccctttaggacgcttgtaataaagt

SEQ ID NO: 367217 - DNA, 1024 bp, Homo sapiens
caacttaggctaggtacgaggctgggtggctggctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttctt

SEQ ID NO: 367218 - DNA, 1304 bp, Homo sapiens
  misc_feature (1261)..(1261): n is a, c, g, or t
  misc_feature (1297)..(1297): n is a, c, g, or t
  misc_feature (1300)..(1300): n is a, c, g, or t
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggaaactacctccgtatgttccgaggttctctgtacaagagatacccctcactctggaggcgactanccactgtggaagagaggaagaaaatagtgcatcgtnacnttgt

SEQ ID NO: 367219 - DNA, 1231 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagggctagtaacagtttttaaataaaaggcaacaggtcatgttcaatttcttcaacaggtcatgttcaatttcttcaaagttttaacataaaaataatgagagccaggagtggggccggggcctggggggacgaaggtggtatgtgaacaaggttggcacacaggcctcaccctcctctgcctcagattcccaagtgggcaggtgggggtgaatggggctccgggtagcacctcagctcctctcagctcccctcagcctgttctccttccagacccagagagctgagaagagtagctgtgaggctcagggcagaggctctctgcctttcaggaacagccctaaccctgctccccttgcttggcctcaggaaggtgccgcgagctctcctgccgtccctgggccgccctgggctctgctgtgtccagatggtcaggctactgccagctggggc

SEQ ID NO: 367220 - DNA, 1643 bp, Homo sapiens
agcggtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagcacgtttcagttccttcctccccagaaaaacactctgctttgaccttgtgctccccacaacgccacagtacctcctcgcctttgaactgttgtgtttccctgacttccaggacattgtccatagcctccttggctctgtctgctgtcaccttgccatgtcctcctcacctctctggcccctcaagtggagttactcagggcgcggtccttgggccctttctctgccctcagtttcacatgagtgggccacagccagtctgatggtgcagatgccatccacgtgactcccactgtgccaccatttcccagagcctgctggagtaaaccaccacaaactggtggcttcgagcagagcacatttcttccctcacagttctggggcccaggagcctggatttagtttcactagaccagactcatgtgtggacagggccatgctccctccagaggccatcgaggcgattcggtccttgcttcttccagctttgggggctgccacgttccagtctcagcctctgtggtcacgtggccttctctgcatgaaacttccctgtctctctcttagaaggacacttggcgatgtaatttagggcccttctggttaatctctcaggatctttcacttaatcgtatcttcaaagtctccttttttggccatatgagctgacagtcacaggttttggggattaagttgtagatgtcttcggggtctgttttttacctctgtggcccagacttcctcagctgccctcaccccctcagcctcatgctgcctgaagacctctccatctcggcgcgtggagatccagccctctccttgctcaggctgtaggtttctttcccaaggcctgccttttcctcacacagcaagtccagtctctgccaggttctcccctgggac

SEQ ID NO: 367221 - DNA, 8168 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367222 - DNA, 8114 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacacttttcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367223 - DNA, 8113 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367224 - DNA, 8414 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgtttttgttttgtttctttacagcattcaaggacagggaaacttacgagagtcttattataattattattatttacaaaatgaccctaataggtctgtttagtaacagtgaaattttttcttactccatttccatacactttctgtaaatatgtataacatgataatgatgcctggtgtattgaaatcctcaataaatactgccaagtgtggatcagttggaaaag

SEQ ID NO: 367225 - DNA, 8698 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggagagaccaaccagggtcaaggagggccagggaattgggttctggattctcaagaccttgtagactccaaagagatggaaagactgtgaagcacaagaaagagaaaccagaacatccactggagaacttggaagagccagaacaacattgttcatcgaagagatccctgtcatcctctagctcgggcaaagggagggacaatccccacattaacaatgagcagcatgaaaggaaacggtccactcaggagaggcctcggagacctctgcttcccacgatcagtggtgaagtgtttctgagcactgaatgtgatgactgggagactaagaataaccatcagactcgaaattgggaaaaacagtctcgacaccaagatcgactttcacccaagtcctcacaaaaagcagggcttcactgcaaggaagttgtatatgggagggaccatgggcaaggtgagcacagaagaaggagacacaggcccaggactcctccattctcagagagtgaggagcagctccacctccatgacgcaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367226 - DNA, 7539 bp, Homo sapiens
ctactccagcctgggcaataagagctattccagcctgggcaataagagctactccagcctgggcaataagagcttgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367227 - DNA, 7291 bp, Homo sapiens
ctcggtaccaacttcgacggagcatcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367228 - DNA, 7473 bp, Homo sapiens
agtgcatgcatgttggggtttcctttaccttttctataagttgtaccaaaacatccacttaagttctttgatttgtaccattccttcaaataaggaaatttggtacccaggtgttgtctttgaggtcttgggatgaatcagaaatctatccaggctaccttccagattccttaagtgccgttgttcagttctaatcacactaatcaaaagacgagcactcccagggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367229 - DNA, 7206 bp, Homo sapiens
  misc_feature (72)..(72): n is a, c, g, or t
cactgttaagtgcgttgcctgccatgattgtgagggttaggagtcagttagttagtattaggagggggtttnttagggggtcggaggaaaagtttggggaacagttaaataggttgttgttgatttggttaaaaaatagtagggggatgatgctaataattaggctgtaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccaccagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagatttttgatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctatttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaa

SEQ ID NO: 367230 - DNA, 4497 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgtttttggagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattccatctttattgtttgttctttttttggtttttaaaagattacaattttaaaatatttatgtttattttatttttgtgtaaagcaaacactttttaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtca

SEQ ID NO: 367231 - DNA, 1670 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctggaatagctgctggaaaagtgctgtagttgcttgaatagctaaagatcctgtagg

SEQ ID NO: 367232 - DNA, 1585 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcacccagtaatatttgctatagtgaggtcgacgcggccgcgaat

SEQ ID NO: 367233 - DNA, 1209 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggagaatgaattagggaacgaatgaatgaatgcggaatgtgctccgctagctcagtcacgcagaaaggggtgcagctccaaggcccccggagggctgatggaggattgtcaaatttaggaagagccggtcagcgcgaggcacagctcgggaaataacccgatctgtcatgaggtc

SEQ ID NO: 367234 - DNA, 2311 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcgtccggacgcattcacaagaattagagaaagtccttacacaactgcatgcaggggtctgctggagaaaaagacagcccaggagagtgcaacagatttaacaggaaacgaattaaaatgtagaaactgattttcaacttacttcgaagagtacataagaaattgcaaactactctctatgcaacattttgaatgctaagtggaaaaccatgcattttggcacgaaatttattaaagattataccatactaattaattactattacttcgttactgaatggtcgtcgaagttgcgacggacgcattcacatcatgcctttcctgaacccagatggctttgagaaggcagcgtctcatcctggtgactcaaggtcagttttgtggcttgatgctatgctctctgcgtatagatctgtgatctggcta

SEQ ID NO: 367235 - DNA, 1282 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggtaacaattcctgcatcatgatctattctatccttagactcaaccataaaacacccctttaattttgttcataaagtgaccttagggacctaggactgtttctcttatccccaggcactgggtacatttagatgtgtggcaggattctatttgaatctaataaattcacgttttgttttgttttgtttttattatactttaagttttagggtacatgtgcacaacgtgcaggtttgttacatat

SEQ ID NO: 367236 - DNA, 346 bp, Homo sapiens
tcagactcgaaattgggaaaaacagtctcgacaccaagatcgactttcacccaagtcctcacaaaaagcagggcttcactgcaaggaagttgtatatgggagggaccatgggcaaggtgagcacagaagaaggagacacaggcccaggactcctccattctcagagagtgaggagcagctccacctccatgacgcaggtaatagaggacagtctcgatggaagtcctggtatcatgtatataactacaaaccaatgaatttaataagtaccttaagcaacctttctttctctctagttcatgctcatgactttgaaataaatcctagagcaacatattataaaagg

SEQ ID NO: 367237 - DNA, 314 bp, Homo sapiens
tccccaaagagcagagtgtgctaacctacaattgaaacatttcaattgaagatctctctttgcccacatcttcaccagcactacataatatcagacttaaatgttgccagtcccataggtgtgaactagcatctcattgttttatttgcatttccctgtttgctaaggagactgagtaacttatgtctctattggtcatttacatttccatcttaaaactatatatattatatgatcatttttaaatttgatggtctctttcttattaatttacattcctacttttttcctagtcctttgtttcataaaatgta

SEQ ID NO: 367238 - DNA, 2576 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367239 - DNA, 2475 bp, Homo sapiens
  misc_feature (790)..(790): n is a, c, g, or t
ctcagctactcaggaggttgaggcacgagaatcgcttgaacctgggaggatgaggttgtagtgagccaacatcgcaccactgcactccagcccgggtgagggagtgagactctgtctcaaaaacaaaaacaaaaaaaaacaaggacagatggaacatgttgtcacacattgggtggtatggggttcatcaggctgcacatgtatgttctgtgcatttttttgtatgttgtagtttacagttacaaagaagatagcaggaagaaatggtgaaaaaagtaggtaagtcttttaaggagttttcctgcaaagcggacagagaactaggtctggtggtggtcgtcaaaggagaacttttttctccctccttccctcccttcctcctagatacttgcatgtgttgtaaagagtgagcacagtggtacatcttttcttagccacagtcagctgcccaggagcagtgctgaatgggcagagctggattttacagggttgggattttgccaggtgagtaagatagaggggagaagtgggaccagggagttccaggtctgtgaacggccctggctgaggagctggatcatgaaatctgagtcaagtaagaaggaaattgaggacacgagttgggtattgcatagtgttactgtgttaaggtcaggggtcaaagacttactggcatggagtaaccagagtaagtgagctggaaagatgagttgtcagggcagagaggggtgcttggaattgaggctttggagctgtgaagtgacaagatgcaggtattaccatgggagtnggcagctgaggtggggtaaaggagatgctctgtggaagggagatgaaggcactgaagtcagccagaaacacaaaaactggtggtggtgagtgagcagagtggcagtgagccccaagcttccagttttctccttggacagtcatcgtaattattattattattttttgagatggagtttccctcttattgccaggctggagtgcaatggtgcaatctcagctcactgcaacctccgctcctggttcaatggttctcctgcctcagcctcccaagtagctgcaattaggcgcccaccaccacgcccagctaatttgtatttagtagagatgggtttcaccatgttggccaggctggtcttgaagtcctgacctcaggtgatccacccgccttggcctcccaaagtaatcacgctgggattacaagcgtgagccactgtgccaggccaagtcatagtaattatgagatgtggatcactggtactgggtacttactgtactgcaggcactgacccacacaagttgtattggttatctcatttaatcctgaccaccctgaggtagggaggtgtccacactgtaaaatgaagaaacagaggctcagaaagttagttgccctgacatcacaaagctggtaagtggaagggccaggatttaaccctggcagcccagagcgtgatttgtattctgcaataccatttccttaatttctgagccttagttccccttttacctataggtatagcaccaagtcccatcacagagtagaaacctgttaaacgttaattttccttgccttcctcaggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaaggtgagttccatgtgcctggcttcgccccacctggtttcagctgctcttccttacctgcctcgccttttacccttccctgtctcctttcctctcctcagagattctgccattgatgaagctgctgtccactcacccctagatttttgttgcatagccagtaagatctctggcctggaatgttttggggaaaactggaaggactgtgttatgggagtgggagtataactggtacctggttaatgctttccctttccattattcttttcttcctccagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacttgggagtcccaaccctgtaaaatccagctctgcccattcagcactgctcctgggcagctgactgtggctaagaaaagatgtaccactgtgctcactctttacaacacatgcaagtatctag

SEQ ID NO: 367240 - DNA, 3489 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtaaaaaaaaaaaaccaaaaacaacacacaagaaacaaacaacaagaacacaaagaaaaaaaaaaaaaaaaaaacacaaaacgcaacaaaaccacagggcggggggggccgcccccacacaactccccgcgagggaggcggcccccgacgcccggccgccgccagcgcgagattgacgggcgaaaaaacagcggcgcggccacccacactaggacgaggcggggacaataaatacagcgaccgcgcacgaggcagcgagccgaagacaataacaacgacaggcacaacggagcgaagagcacaaaacaccgcacaccaggccgaccaaccctacgcagcaaacgcggcacccacaaccgccgcgccggcgggaggagaaccaaccaacgcggcggcccacaccaccaccgcaacgcgagacactacaggcacccgcacacccgaagcggagaacacacaacaacccaacaacagcagccggcagtacaacacgacgagcgggaaacaaccagacacgagagcaatcagcacgcgcagggacagcacaaacaaagaagcgccgcaccgccacgagagaacgacacaaacgcagagacaaaacaacttaacaatgaagcacggggaggcgaaacgaaagaaaaggaacacaaaacacccacaaccaccacagcacccagagcgacacacgccccacaagcgaccgggagcggaggagggaagcaggggaaggagacgagagggggcggaggcgagacgcacgaacaagagcgagaaggcggggggagaccaagcaggcgagtgggggaagcaggcgacagcgaacaggcaccgaaacacacgccgcacaacagaaaggaggagggagcaagaaacaaacacaccaaacaaaggagagagaaggaagaacggacgagcc

SEQ ID NO: 367241 - DNA, 2764 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtacacatcattccgagccgccttggctgtcttgtaaccacgtttctctgcccaggcttcacagatgtcccaggcacaccaggggtgttccgctgaggggtcctcagcctctgggtggcgcaggtggagcagggcctgcacgggaattcgggaggccaggtagcccacagcaggtcgacgcggccgcgaat

SEQ ID NO: 367242 - DNA, 2197 bp, Homo sapiens
cacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367243 - DNA, 2207 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcaaacaatctttattcacaattggggtggcagaggggagatacccccaggtcagtccaaaag

SEQ ID NO: 367244 - DNA, 2175 bp, Homo sapiens
cacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367245 - DNA, 2424 bp, Homo sapiens
  misc_feature (790)..(790): n is a, c, g, or t
ctcagctactcaggaggttgaggcacgagaatcgcttgaacctgggaggatgaggttgtagtgagccaacatcgcaccactgcactccagcccgggtgagggagtgagactctgtctcaaaaacaaaaacaaaaaaaaacaaggacagatggaacatgttgtcacacattgggtggtatggggttcatcaggctgcacatgtatgttctgtgcatttttttgtatgttgtagtttacagttacaaagaagatagcaggaagaaatggtgaaaaaagtaggtaagtcttttaaggagttttcctgcaaagcggacagagaactaggtctggtggtggtcgtcaaaggagaacttttttctccctccttccctcccttcctcctagatacttgcatgtgttgtaaagagtgagcacagtggtacatcttttcttagccacagtcagctgcccaggagcagtgctgaatgggcagagctggattttacagggttgggattttgccaggtgagtaagatagaggggagaagtgggaccagggagttccaggtctgtgaacggccctggctgaggagctggatcatgaaatctgagtcaagtaagaaggaaattgaggacacgagttgggtattgcatagtgttactgtgttaaggtcaggggtcaaagacttactggcatggagtaaccagagtaagtgagctggaaagatgagttgtcagggcagagaggggtgcttggaattgaggctttggagctgtgaagtgacaagatgcaggtattaccatgggagtnggcagctgaggtggggtaaaggagatgctctgtggaagggagatgaaggcactgaagtcagccagaaacacaaaaactggtggtggtgagtgagcagagtggcagtgagccccaagcttccagttttctccttggacagtcatcgtaattattattattattttttgagatggagtttccctcttattgccaggctggagtgcaatggtgcaatctcagctcactgcaacctccgctcctggttcaatggttctcctgcctcagcctcccaagtagctgcaattaggcgcccaccaccacgcccagctaatttgtatttagtagagatgggtttcaccatgttggccaggctggtcttgaagtcctgacctcaggtgatccacccgccttggcctcccaaagtaatcacgctgggattacaagcgtgagccactgtgccaggccaagtcatagtaattatgagatgtggatcactggtactgggtacttactgtactgcaggcactgacccacacaagttgtattggttatctcatttaatcctgaccaccctgaggtagggaggtgtccacactgtaaaatgaagaaacagaggctcagaaagttagttgccctgacatcacaaagctggtaagtggaagggccaggatttaaccctggcagcccagagcgtgatttgtattctgcaataccatttccttaatttctgagccttagttccccttttacctataggtatagcaccaagtcccatcacagagtagaaacctgttaaacgttaattttccttgccttcctcaggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367246 - DNA, 975 bp, Homo sapiens
ggatctggggatactgttgatggaaataatgcttccaggcaaccacaagagctggcggggccagatccaccttgttcaaaaccagcaccagggccagtccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367247 - DNA, 1352 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggtttggactgacctgggggtatctcccctctgccaccccaattgtgaataaagattgtttgctttgta

SEQ ID NO: 367248 - DNA, 402 bp, Homo sapiens
gctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggtatgacggggagggtgggtaagggaaagagagaaggtgggacattgaggaaagtactgagtgctcatttccctcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaaggtgagttccatgtgcctggc

SEQ ID NO: 367249 - DNA, 2664 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttt

SEQ ID NO: 367250 - DNA, 2407 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttcccctcttttcctcgggacccccgcaccccacaggatcctagtagtgtcttgaagaagagtcggaggcgggggagaggatggactcgggccctggggccagagcagttgctgagagcctggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367251 - DNA, 2851 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaaggtgagttccatgtgcctggcttcgccccacctggtttcagctgctcttccttacctgcctcgccttttacccttccctgtctcctttcctctcctcagagattctgccattgatgaagctgctgtccactcacccctagatttttgttgcatagccagtaagatctctggcctggaatgttttggggaaaactggaaggactgtgttatgggagtgggagtataactggtacctggttaatgctttccctttccattattcttttcttcctccagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367252 - DNA, 2554 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367253 - DNA, 1690 bp, Homo sapiens
tgtgtagtatctcatacgatgatttgagagagaaggcggaggaggtaagaggagaaagagagaggcggagcagtttaagcggagggtgagttgtgtgggcgtcgtgattcggggaggtgtatagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367254 - DNA, 2289 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367255 - DNA, 2049 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtaaggaagtggcagcttgtgcgtggtggcctccaaggaggtacagagttttcatattcggagaagagagagggcgatcaggtctcattaggccccagggtgtctgaggggtgatctctgccagtggcggtgggcaaggcagaagaggcgtctgctgcagtggaaggatcatgacagcctgagttaaattccacctcttctcagctgtgaggtcttgagtaagtgattttgctactctgagtcttagttactttgattttaaaaataaggacattgatacctgagtaaaagaatggatgacggcca

SEQ ID NO: 367256 - DNA, 1176 bp, Homo sapiens
ctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgta

SEQ ID NO: 367257 - DNA, 820 bp, Homo sapiens
attgccaatagaaccatgaaaaataaacacttcattaaaagtaaacacatgtacttggaaacccattactgttttcttttcaagttgcaaattacaaaatatttaagcacttttatttgccttttaaaatgttaaacaattatattctttttacccaaaatgagcaggattcagcctggacacaatggtagagactggctgtactactccctcccccaacgattacacaaagtggcatagtaattcagtatcaatccattatattctaaaaaactcagcctgggtagttgctcaaattttaataactataccagcctttggaaggcttgggaaaagcagttggactgtactttataggacagacttgaacttgagcctatacataatgccacctaaagttcagttctgcatatacacgtgcgtgtgtgcacacacacatatatattatcagttaaaacagtcacatatgtgaatagaatgaatcaaataggttattgacatcacagatatgcctagccttagatgttaaattgggtgtctcctttgtttaaatggatttcagtcgaaatggttggcacagtgctattatgcagctaaggacgcgttatcaaagaaagactgaagagtgctgtttcttcctggggttaatggcaaaatccttccctctgcaaagactgcccacgttctgcctgctgtggggctctatagctacaagaagcagaagaacggagcataggaaggctcgaatacccactttagccccaaccttgtctgtttggtcttccatccaggggagaaaaacaataatatccagcctttt

SEQ ID NO: 367258 - DNA, 1214 bp, Homo sapiens
ggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatgtggatggatggatggatggatggatggatggtggatggatggatggatggatgggaaataaagagatttggctgtagtgggagggaggtttcagtgctttttctggggacattggtgcctatctctattctgagagttgttctcctcataggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctg

SEQ ID NO: 367259 - DNA, 290 bp, Homo sapiens
ggtggcatattcctgtagtcccatctacttggaaggctgagactggagggtggcttgagcccaggagttcaaggctgcagtaagctatgatctcaccactgtactccagcctggttgacagagcaagaccctaactctaaacccaagccccagcctgaccccagtccttccctcttggactcagagttggtgtggcctacctggctatacatcttcatccctccccaccatcctggggaagtgatggtgtggccaggcagttatagattaaaggcctgtgagtactgctg

SEQ ID NO: 367260 - DNA, 1468 bp, Homo sapiens
tgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacatttactctgtttctttgtgccctgcaagccctgcccccaagacctagataagatctttctcttcttttgcccccactcaaattagaagtggggagcctcttgggccacatctctgttaactggggaggggaggtctcatgggtcttttttaactgatcaggagccctaagta

SEQ ID NO: 367261 - DNA, 2231 bp, Homo sapiens
gtcgtgtgccgggtggggcttccgcagtgccctacctggaatcggtggccgcgccgctacccctttctctcgactccaagccagagtctggcctcatccctctcttcacccccgggaactccatacctccaaaggcctgaggccctggccggcgcacactcccatccgtcaccgtcggggccctttccctctgcacctgttagggaggccgcaggggttttccattcctcccagcctggctccagagcaggtgccaggaagggggcatctgaatattttctgcctgtcccccacgagctggagaagcgcgaggcggctccaggaaattcctgaagctctctcccttcccgccaaggagagggcccactctccctccccaatccgctccccgatcagaaggccatgtcattggccagggcacagaacagatacacccatcctccctctttccccccatttctggtcagcgggcgggtttgtatatgtgttttcctgctccctgggcccacaagctacctctgagcacctgcgcgctcccaggagcggaagggacacgctgagggaaggcggagatccagcaggtcttcccgggggaggctcggccaccgccgggaagtgtactctctggctggggagccagataaaaccacaggtggtgttaggcgagaaatcagtggattcctgcagggggtactcgatgagagctggggacatcaggataggggcctcctgacaggccagctggaaaggtggagccgggaggggagaggagtattcacacaggcccgagggaagggctgagcccccgcctgggaccaagctgtgggcctggtggaaaaggccttgccagtcagactgagaagtcggggccttgtgctgtgggcagcaggccgctaagcagaggagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacatttactctgtttctttgtgccctgcaagccctgcccccaagacctagataagatctttctcttcttttgcccccactcaaattagaagtggggagcctcttgggccacatctctgttaactggggaggggaggtctcatgggtcttttttaactgatcaggagccctaagta

SEQ ID NO: 367262 - DNA, 1208 bp, Homo sapiens
gtcgtgtgccgggtggggcttccgcagtgccctacctggaatcggtggccgcgccgctacccctttctctcgactccaagccagagtcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacatttactctgtttctttgtgccctgcaagccctgcccccaagacctagataagatctttctcttcttttgcccccactcaaattagaagtggggagcctcttgggccacatctctgttaactggggaggggaggtctcatgggtcttttttaactgatcaggagccctaagta

SEQ ID NO: 367263 - DNA, 1770 bp, Homo sapiens
  misc_feature (1661)..(1661): n is a, c, g, or t
tgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtaagccctggaacgtggcctgctgtgtgcagtgtggccaggggtctgtggctagcagagaggacctgccctaaagatagagtcttgatgcaccgtctaccttgtccccaaccaagagtgagtagtgcacagaagtctcctggcaccctgggaatcctgcatttttaatggacgaacaggcaggaaagaaaaaaaaaacccaaaccccatcactctgccagcccctgtgaccaaagcagcccaaatcagttaccttgacaactctcatgcacagactgcaccagcctgtgttgcaaacatcactgccccgcttctaacaggaagagatactcttttgggggtcttgcagggcccaggaccagagccccttctacccagggcccttccaaaggcaaagcacagagtcacatttgggcgtggcatgagagggaaataaagagatttggctgtagtgggagggaggtttcagtgctttttctggggacattggtgcctatctctattctgagagttgttctcctcataggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgcagaancacaatgtatacctctatgaaaaaactggagggggggcccggaacccaattcgccctattgtggggaggattacaataactggcccccgtttacaacgctggaatggga

SEQ ID NO: 367264 - DNA, 1075 bp, Homo sapiens
ttaggctagtcgaggctgggtgttggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctg

SEQ ID NO: 367265 - DNA, 1129 bp, Homo sapiens
tgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctg

SEQ ID NO: 367266 - DNA, 1463 bp, Homo sapiens
ttaggctagtcgaggctgggtgttggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacatttactctgtttctttgtgccctgcaagccctgcccccaagacctagataagatctttctcttcttttgcccccactcaaattagaagtggggagcctcttgggccacatctctgttaactggggaggggaggtctcatgggtcttttttaactgatcaggagccctaagta

SEQ ID NO: 367267 - DNA, 1460 bp, Homo sapiens
cgcacgacggcagcccgcgcgaggatacgcttgtaagccgggttagttggccgagggtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacatttactctgtttctttgtgccctgcaagccctgcccccaagacctagataagatctttctcttcttttgcccccactcaaattagaagtggggagcctcttgggccacatctctgttaactggggaggggaggtctcatgggtcttttttaactgatcaggagccctaagta

SEQ ID NO: 367268 - DNA, 1655 bp, Homo sapiens
tgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtaagccctggaacgtggcctgctgtgtgcagtgtggccaggggtctgtggctagcagagaggacctgccctaaagatagagtcttgatgcaccgtctaccttgtccccaaccaagagtgagtagtgcacagaagtctcctggcaccctgggaatcctgcatttttaatggacgaacaggcaggaaagaaaaaaaaaacccaaaccccatcactctgccagcccctgtgaccaaagcagcccaaatcagttaccttgacaactctcatgcacagactgcaccagcctgtgttgcaaacatcactgccccgcttctaacaggaagagatactcttttgggggtcttgcagggcccaggaccagagccccttctacccagggcccttccaaaggcaaagcacagagtcacatttgggcgtggcatgagagggaaataaagagatttggctgtagtgggagggaggtttcagtgctttttctggggacattggtgcctatctctattctgagagttgttctcctcataggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctg

SEQ ID NO: 367269 - DNA, 1080 bp, Homo sapiens
tgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctg

SEQ ID NO: 367270 - DNA, 359 bp, Homo sapiens
agtttatctggcctttgatcttagttcctgacaaagaacttcaaacatcctgggaatttcctgagagatagaaattatttgttatgctaatgaggtaactcatgacagactcctagttagcttcaggatgggagatggacaccagaaagaccaaacacacgattagaaggctggaactttgggccagttttacctgcatggaaaagagggctagagactgagctcaattatgtggccaattgcatatccaatcatgcctgtgtaatcatattccacataaaaaatgtgtacactgaaactcagtggagttttctggttggtgaacatactggtgtacagggaggatgatgcactcagat

SEQ ID NO: 367271 - DNA, 198 bp, Homo sapiens
aaattttttctttcttttatttttctttctctttttttctttttctttccttctttcttctttcctttttttcattcgccagatccaatctctgctatgggtccacagtcctttatccaaaacccttgtggcttcaaagttaaatattttcctaattttagaagggaatggagtgcctataatgtatatcaaaccaca

SEQ ID NO: 367272 - DNA, 1507 bp, Homo sapiens
aggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcagagtctcactgtactccagcctggacgacagagtgagactccatctcaaaaaaaaagaaagaaattcatgataatgctatcctctaggtgggaaggagaaaccaaaaacaaatatagaagacttacaaattaaaaaggtaaacaaaaaaataa

SEQ ID NO: 367273 - DNA, 1387 bp, Homo sapiens
aactgtgagcatttgctatatgtcagaatggtagcacacactgtagatgtaactttgctctatgcccgtctgtctgtctgtctgtctctctctttctctctctctctctgtctctctctcgctgtgtacatgaagagactggctggctgggtgtggtggctcacgcctgtaatcccagcacttcgggaggccgaagcgggcagatcacgaggtcaggagtttgagaccagcctggccaacatggtgaaaccttgtctcttctaaaaacacaagaattagctgggcatggtgacgcgctcctgtaatcccagctacttgggagactgaggcaggagaattgcttgaacccaggaggtggagtttgcagtgagacaggattgtggcactggattccagcctgggcgacagagcaagactctgtctcaaaaaaggctgactaaatattgattatcaattctgtaaaaaatgagtcctaaatatataattctgagtaaattttcagaagtaaacttcttacttagacaaaactgttcctaaagcatggtttttaaagtaattaaaatatggagtttcaaaaaacattttttccaacaggtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcagagtctcactgtactccagcctggacgacagagtgagactccatctcaaaaaaaaagaaagaaattcatgataatgctatcctctaggtgggaaggagaaaccaaaaacaaatatagaagacttacaaattaaaaaggtaaacaaaaaaataa

SEQ ID NO: 367274 - DNA, 1423 bp, Homo sapiens
aggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcagagtctcactgtactccagcctggacgacagagtgagactccatctcaaaaaaaaagaaagaaattcatgataatgctatcctctaggtgggaaggagaaaccaaaaacaaatatagaagacttacaaattaaaaaggtaaacaaaaaaataa

SEQ ID NO: 367275 - DNA, 880 bp, Homo sapiens
taggatcccctccgccccaggacaaggttttgaacgacagactacagctgctgttggtgtgctgaaggctgtgcactgtggagagtggtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcagagtctcactgtactccagcctggacgacagagtgagactccatctcaaaaaaaaagaaagaaattcatgataatgctatcctctaggtgggaaggagaaaccaaaaacaaatatagaagacttacaaattaaaaaggtaaacaaaaaaataa

SEQ ID NO: 367276 - DNA, 464 bp, Homo sapiens
gttagtataataaatgtaaatgggttaaacttgccaatcaaaaaatagagactttcatatacaaaaacctacacatggacatattacagtgaaatctgaaaaaaaaaaatctctaaaagataccagagagaagcagaccacctacaaagaaacaagggtcaagctgacatcagatttttcatagcaatgctagaagtgagaagaatgtaatatctttaaagagttataggcaaagtactctaaactgtaggggtaggagtagagatactaaagagacatagcagtgtgaaaaagtatttagcttgtttaggggaaaagtagacactgataagcataagcatcaataggaataagcaggtataaaattggtcttaatggcacccaccataagaccaaaatagaatgtataactttttgactgctcgggaatactctgtttgtccaagggaaacaagtgaagagga

SEQ ID NO: 367277 - DNA, 237 bp, Homo sapiens
cacacactgcacgtggccttctgtgtctggcgtctctcactgggcgtgacgtccccaaggtgcatcggcactgtggcctgggtcggagcctgactccttttcatggctgaatactattccacgggttgggtgggccatggtgggtttatcccttcttccatctgtagacagttgggctgtttctaccctttggctgcagtgagtagcatgctggggaatttgtgtgcaagtatttgt

SEQ ID NO: 367278 - DNA, 360 bp, Homo sapiens
ctaattccttcccatgaaaaccacattttagtagcagcctagttgaattaaaggcatctcatggcttaatttaaagagaaaataaggtttgccacagtaattaaccaaaaaagagacaagatgtcttagaagagagattcaaattatcccaatgctgaagttaataggaatgcttttttgcttttctccctagaggctatgtcgatctggcaaattagtaatgtgcctcagctcattggtattctatgccaagaacttgtgctgcaagataaaagaatgtgactgtagtaaaccctacaataatgactttccctgagcttctctagggcgtttctggtttattcacccttccctttctca

SEQ ID NO: 367279 - DNA, 368 bp, Homo sapiens
gttctccttgccctttgctcagccttctcacattaaagaattttttaaaaagtttaaactagtatatttttattgtcctggtttatattacatttaacattataaaacacctaaaatccttttaggaaataggtgggatataaatgctaaatagctacacaggttaagtaaataaataaataaatctatgtggtactacttactattttaaataggtcagtgagtccctagagagtggcacctctccagcagaatcctttcacttcagtcaagccaccttcagattccttttccctgcctgctattcaagaacagatttttcacatgctatttaagatacttctgaaaggatcttcctcaaatcctac

SEQ ID NO: 367280 - DNA, 786 bp, Homo sapiens
ctccctgtccccatctgaggtctggcagctcttagtcatgtcttggagggaggacgggcatccagggctgaccggtcaacgtccagcacctcccagggactatgggaagactgagtggtgggtctcgtcctctcgggatacttgcgcttctcttactggtgattgtgtgccccctgttgtgtgccttcctggacctctctgagggaggaaagggcagggcctgaaacgttctcccggccacagcctccctgttatccctcccctctgcttccttcgccaggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcaggtgaggaggtggcgcggtggtgtggtgggcagtgctgggtggtgcccagttctgtggggaggagcctcttcccggctcgctgaggtctctcttgctgcaaggcaagtcctttcctctagttgcgttcctggaggagaggcgatgatctccctgttcaattaaatattaaaaaaaccttctggccaggcacggtggctcatgcctgtaatcccagcactttgggagacagaggtgggtggatcacctgaggtcaggggtttgagaccagtctggccaacatggtgaaaagtctctactaa

SEQ ID NO: 367281 - DNA, 456 bp, Homo sapiens
gtcgactctgaggatccctttggtaggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaaggggagtcctctagagtgacctc

SEQ ID NO: 367282 - DNA, 419 bp, Homo sapiens
cgatctctagcaggatcccctttggtaggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaaggggagtcctctagagtgacctc

SEQ ID NO: 367283 - DNA, 6886 bp, Homo sapiens
cgcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367284 - DNA, 479 bp, Homo sapiens
  misc_feature (12)..(12): n is a, c, g, or t
tccccgctggcnttttgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaaaccccggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaaaccccagcgctcaaaaccccagcgggggatcctttaga

SEQ ID NO: 367285 - DNA, 538 bp, Homo sapiens
caacaacttcgtccattcggacctgagacaccatatgatgtagtttggttactcggcgtgtgcatgcacacgccgaaaccccaaacacttcttcaggtctgcacacgccgagtatccaaacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtctgggcgctcggcgtgtgcagggatcctctagat

SEQ ID NO: 367286 - DNA, 181 bp, Homo sapiens
acgaggggtttccacacctcagacacgcacagaaggcacttggtgaactgtgcgtgtctgaggtcacatgaattgaaaaggagacgctgctcccacggaggggagcaggaatgctgcactgtttacaccctgactgtgcttaaaaacactttcactaataaatggttataaatcaaaaaaa

SEQ ID NO: 367287 - DNA, 4242 bp, Homo sapiens
cgcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcaaaaaaa

SEQ ID NO: 367288 - DNA, 839 bp, Homo sapiens
  misc_feature (99)..(99): n is a, c, g, or t
  misc_feature (141)..(141): n is a, c, g, or t
cggaggatatccaggcagaagctgcaacttgagaaggtcacggctgaggccaagatcaagaaactggaggatgagatcctggtcatggatgatcagaanaataaactatcaaaagaacgaaaactccttgaggagaggatnagtgacttaagcgacaaatcttgcagaagaggaataacagggcaagaatcttaccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaaggtgggcagatcacgaggtcagaagtttgagaccagcctggccaatatggtgaaaccccatctctactaagaattagccgggcatggtggcacgcacctgtaatcccagctactcaggagggtgaggcagaagaatcacttgaacccggaggactgaggttgcagtgagtcgagatcatgccactgcactccagcctggacaagaacaagactccgtctcaaaataaataaataaataaataataaataacacactttggaaacaaaaataagtcaagttaataaactgttatccaacatgggataaaatatatgaatcacaggcccctgagacttcagcggcacagatcatctgcatttaatcctacaca

SEQ ID NO: 367289 - DNA, 351 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaagtccagggcagaggaccaacgtcgacgcggccgcgaatttagtagtagtaga

SEQ ID NO: 367290 - DNA, 504 bp, Homo sapiens
ttatttaagagccaacattaatatttaagcaaaattttgcagttcacagacatcctttcaattctattactttgtgtatttgtttgccagtcattacagatgtcctaggcaggtgatatgctccacattttgcagctgaggaaattttaggtccagagatgttaggtgaatgacccaaggtcacacagctagagaggggtggtgatgaggactgcagctctgggtcctggaagagctctcattcttttgcacggcactgagatgaccctctgtctccacccaactgccattcactgtgttcctcccaccaagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggtaatgctttttggtgatgctttttggtgatgacacataagagtgac

SEQ ID NO: 367291 - DNA, 495 bp, Homo sapiens
ggtacccttctctcgggccctgaagagctggaggacgagctgcaagccacggttgacgccaaactgcggctggaagtcaacatgcaggcgctcaagggccaattcgaaagggatctccaagcccgggacgagcagaatgaggagaagaggaggcaactgcagagacagcttcacgagtatgcagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggaccttaaaatgggagtaatgggctgggcatagtgcctgccacctgtaatcccagcactttgggagaccaaggcaggaggatcacttgaggccaggagttcaagaccagcctgggcaacatagtgagaccctcctat

SEQ ID NO: 367292 - DNA, 562 bp, Homo sapiens
  misc_feature (1)..(2): n is a, c, g, or t
nngagtaggaaacggacactcgagacgcagacttcaatggaaccaaggccagtgaataagcaacttactacagttttgcaccacggcaagaaaaccaaaaaccaaaacatacaaacaaaaaaaacccaacaacaacccagaacaaagcaaaacccagcagactgtacttagcattgtctaaatccattctcaaattccaaatatcacatcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaaaccccaccccagcgctcaaaaccccagcgggggatcctttaga

SEQ ID NO: 367293 - DNA, 4842 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367294 - DNA, 4233 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367295 - DNA, 5021 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgggagcagcgtctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcaaaaaaa

SEQ ID NO: 367296 - DNA, 4719 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367297 - DNA, 4753 bp, Homo sapiens
  misc_feature (42)..(42): n is a, c, g, or t
  misc_feature (45)..(45): n is a, c, g, or t
  misc_feature (1970)..(1971): n is a, c, g, or t
  misc_feature (1975)..(1976): n is a, c, g, or t
  misc_feature (1978)..(1978): n is a, c, g, or t
  misc_feature (1981)..(1981): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgagggnngcannancanctggacgaggagatggaggccagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367298 - DNA, 4472 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367299 - DNA, 4690 bp, Homo sapiens
  misc_feature (42)..(42): n is a, c, g, or t
  misc_feature (45)..(45): n is a, c, g, or t
  misc_feature (4406)..(4406): n is a, c, g, or t
  misc_feature (4414)..(4414): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagacctgtctcanacacacancaacaacacctactacccctgtatcaaggtcacaatgacgtgttgatgcaaaaaaaaaaaaaaaaaaaatttgggggcggtccgacccagaaaggtttaaaccactcggtggggccgggcccaagtgaatgaaatggcctcgggccagaggccgggcagcagcgggttccccaaagacccggcggccgggttcgacacccaggtcggcctcgtcaccaggcgccgagcccccccgccgcgaaagcaaaataaacgaaaaaagacaaccgcaaaacg

SEQ ID NO: 367300 - DNA, 4411 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaaggggagtcctctagagtgacctc

SEQ ID NO: 367301 - DNA, 3924 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367302 - DNA, 4218 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaaggggagtcctctagagtgacctc

SEQ ID NO: 367303 - DNA, 4126 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaatacctataaaccctaaaactaaactatatcaaaaataaaaatccctaaccaacaatccccagtaaa

SEQ ID NO: 367304 - DNA, 4156 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgattagcatttaagtttggaccaggaaaaaaaaaaaaaaaaaaaaaaatttttgggccgggcccagaaagtttagactctttgggggggccaaggtggacggtaggttcaggaacggggagagggtggtctccaaaaagggggggagggtggacacaagggtgggtggtacaggcg

SEQ ID NO: 367305 - DNA, 4117 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaacctagacaaccaccaaaacccgacacaccccgatccgtgcatcatttcgtc

SEQ ID NO: 367306 - DNA, 3862 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcttctcaggaggctgaagcaggagaatcgcttgaacccaggaggcagaggttgcagtgagtcaagatcatgccactgcactccagcctggccaacagagtgagactccttctc

SEQ ID NO: 367307 - DNA, 2881 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaaaccccggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367308 - DNA, 3548 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatc

SEQ ID NO: 367309 - DNA, 2718 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagtcccggaagaagaaaatgatacgggtccgagctgcat

SEQ ID NO: 367310 - DNA, 2787 bp, Homo sapiens
  misc_feature (42)..(42): n is a, c, g, or t
  misc_feature (45)..(45): n is a, c, g, or t
  misc_feature (2682)..(2682): n is a, c, g, or t
  misc_feature (2687)..(2687): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagncccanatggaggagatgaagacgcagctggaagagcatggaggacgagctgcaagccacggagacgcccaactgcggctggaagtcaacagggatcctctagatc

SEQ ID NO: 367311 - DNA, 2830 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggtgagtgtcctgccacatcatccaggggacctggggggtggccttcctcggggcaggtccctgggacctctttgcatcccttttgcaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccaggtgcctgccccgtgtccttgcttccttcatgggtcctctcaacttctctgcgctgagatcccccgcaggcagatcgcggtggagtgttggtgcgatggtgcttgaccccccagcttcccctgctattgggtttctccaacgaggagacatggtcttcgcttctcagagtctgtggggccagggacaggggccattcatggtccccctctcaccctaccctggacgctgtccttgtagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaaccccttatcacccaaaggcacgctggtgctgcttggccgtctctccccgccatctctgttcttgctgctccgcccagaggctgggccacctgttcggtttgggg

SEQ ID NO: 367312 - DNA, 2224 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcaggtgaggaggtggcgcggtggtgtggtgggcagtgctgggtggtgcccagttctgtggggaggagcctcttcccggctcgctgaggtctctcttgctgcaaggcaagtcctttcctctagttgcgttcctggaggagaggcgatgatctccctgttcaattaaatattaaaaaaaccttctggccaggcacggtggctcatgcctgtaatcccagcactttgggagacagaggtgggtggatcacctgaggtcaggggtttgagaccagtctggccaacatggtgaaaagtctctactaa

SEQ ID NO: 367313 - DNA, 149 bp, Homo sapiens
gcaggttcaggatgctgcagggcagggctctgttgacagcagggtgtggcttcatgacccccgcaccttctcttcccccctccctagggcttttgccaagaggcagcagcagctgaccgccatgaaggtgattcagaggaactgcgccg

SEQ ID NO: 367314 - DNA, 589 bp, Homo sapiens
ttgtccaggcaggagaagatagtggagacaatggtggtgaagagaagtgggggggttgggagatatttgggagctagaagcaatcaaactgctgatggacaggaagtgagggagacgaggtgatgaggaggaagccccaggttccagccaggcgatgctagtgtcaccaagaaccagagagatcatgaggcagccattgccgaagcaaagagatgaaaacccagaggggggcactgctttgcccctcggccctcagctaagccctccttgggtgcttctgttggtaccctcatggcctggccaggtgggtcatccaggtaggaggtttggggctttgctgcgccatggtttctggccccagggatccactgccctctttgacctttgcagtccggcaagctggatgcgttcctggtgctggagcagctgcggtgcaatggggtgctggaaggcattcgcatctgccggcagggcttccccaaccggatcgtcttccaggagttccgccaacggtaagtcccaaggtctggcccaggtagggcagggggtgagcgggactgggtggaggaatggatgctggaggtacccg

SEQ ID NO: 367315 - DNA, 482 bp, Homo sapiens
tctgcctcctgcttgcccacagcatggggttaacggctgaagttgggcagcaaagcctgaactgtgttttcctgttggcagggcaaattcatccgcatcaacttcgacgtcacgggttacatcgtgggagccaacattgagacctgtatcctttccctgagcctgggccaaatgggtacccctgccccctaccaatctcctgcccagaggctgggagagtccaagagccacctctatctttccagcctcttaggtttcttccagaacaaatctccccttaacagcaggcattgtggtgcagtggttatacatgtgtggaccggacccctggtttgaaccctaaacaagcagcctaggctgcatgtgatgctcaaatgatctgtcccttagctgagtgaccttgggctggttactccacctctctgtgcctcatcagcaaaatggggatgataatgaatggtacctgcctcatagaaatgtga

SEQ ID NO: 367316 - DNA, 6925 bp, Homo sapiens
cgcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367317 - DNA, 954 bp, Homo sapiens
gatctcggcggatgcccatgcgttgtgtatagttggccagctcttcatggaatgcctgaggttgggtgttctctctgattcaagccctacttgtctcccacagaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtaccagccacagggcccaggggactctgtctcaggggacccccagtggctgctcagcgcagagacagtctgagagtggcagaaccttgggctgcctggaaactgcaaagccatctgctgctaagcgaatcccaaccaagtcctattcgtaatttgtctacgcatctgtaaggcatcagctgtagccactctcgtgttttccaaccgtgacgtccgagacagttatttctttctgtttttgttggagacagggtctcgctttgtcgcccaggctggagtgcagtggtgcgatcatagctcactacagcctcaacctcctgggctcacacgatcctcctgcctcagcttcccaagtagctgggactacaggtgtacaccaccatgcccagctaaaatcttttttcctttttgagatggaattttgctcttgtcatccaggctggagtgcaatggcgtgatctctgctaactgcaacctctccctccgggttcaagagattctcctgcctcagcctcccaaatagctgggattacaggcacctgccaccacacccagctaatttttgtatttttagtagagaagggtttcgccatgttggccaggctggtctcaaactcctgacctcaggtgatccacccgcctcggcctcccaaggtgctaggattacaggcatgagc

SEQ ID NO: 367318 - DNA, 404 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggtccagggcagaggaccaacgtcgacgcggccgcgaatttagtagtagtaga

SEQ ID NO: 367319 - DNA, 4881 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367320 - DNA, 5182 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaaaaaaaaaaaacaaaaaaaaaaaaattgttgggggcgggagggccgcaaaaagagttttaaaacccactcgcgtggggcggccggggcccccaaatggtacgggaccgcatgggctacaacggggtgcccaaaaaaacacccgtggccaagacaaaggcggcgtggttcctcccaaaataaaaagacccgcgcgagacacaccaggccgttcggaccaaccccaagagggggtctggagggcacaaggggaccaacccaacaggggcccaggaggcgaaaaaaagagaggggcgggggggag

SEQ ID NO: 367321 - DNA, 5206 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggtgagtgtcctgccacatcatccaggggacctggggggtggccttcctcggggcaggtccctgggacctctttgcatcccttttgcaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccaggtgcctgccccgtgtccttgcttccttcatgggtcctctcaacttctctgcgctgagatcccccgcaggcagatcgcggtggagtgttggtgcgatggtgcttgaccccccagcttcccctgctattgggtttctccaacgaggagacatggtcttcgcttctcagagtctgtggggccagggacaggggccattcatggtccccctctcaccctaccctggacgctgtccttgtagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367322 - DNA, 4885 bp, Homo sapiens
  misc_feature (42)..(42): n is a, c, g, or t
  misc_feature (45)..(45): n is a, c, g, or t
  misc_feature (2109)..(2110): n is a, c, g, or t
  misc_feature (2114)..(2115): n is a, c, g, or t
  misc_feature (2117)..(2117): n is a, c, g, or t
  misc_feature (2120)..(2120): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcnngcannancanctggacgaggagatggaggccatgcagaacctggaggcgccacatcttccactctacaacatccgagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367323 - DNA, 4451 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacaggcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367324 - DNA, 4852 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367325 - DNA, 4366 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagtcatcatgtcttttttaggagcagtttctgttgatgtattttttccctctgaagggatcataccaccctgtttctttatatgccttgtgattttttttgttgttgttgggtttgtttgtttgtttgttttttctgagatggagtcttgctctgtcacccaggctggagtgcagtggcacgatctcggctcactgcaacctctgcctcccgggttaagcgattctcctgcctcatctaccaaagggatgctcta

SEQ ID NO: 367326 - DNA, 4179 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaaggggagtcctctagagtgacctc

SEQ ID NO: 367327 - DNA, 4227 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaaaccaaaacaaacaaacaaaagcccacagacatcttagggacagaagatattcaaattttatccaatgttctccttaaagtagcagcagatacgctatacacttcctattggtctgatgtaatcttcacacatacacaaaatcacaccagacaag

SEQ ID NO: 367328 - DNA, 4225 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaaaccaaaacaaacaaacaaaaaaaacccaacaacaacccagaacaaagcaaaacccagcagactgtacttagcattgtctaaatccattctcaaattccaaatatcacagacacccctcatcctaccaaaggggagtcctctagagtgacctc

SEQ ID NO: 367329 - DNA, 4074 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagaaaaaaaaaaaaaaaaaaaaaaaaaaatttttttgggccgccttggcccaaaaaattttaaaaaccatttttttgggccacgagaccccaaggtgggtcaagcttgtaacattgggccaaaagacggatcccataggaaaaacccctgggacattgaacaagtggtgctgtgggtccccacaccaaaataaaaaaaaacgcccgcccggggggagcaaaccaacggacgtgtgcttaaggaacaaaaatcgcagagaatgcagagaccaagggacgcacaaacacgaggatgccaccacacaaggaggtgccaaagacggagagcgacggaattcaaaatttaacgccccgcccccggaggagaacacacaagcaccaagcaagaaacacaccacacacaacgagaaaaacacacgaacacaacagccaccacgacggatctacgacgaaaagacaacatgaggaccaccat

SEQ ID NO: 367330 - DNA, 1237 bp, Homo sapiens
  misc_feature (10)..(10): n is a, c, g, or t
ggtccagctngacaggtggggcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 367331 - DNA, 2865 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggaga

SEQ ID NO: 367332 - DNA, 3206 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcaggtagagggcgtggggtgtcccccactctggccatggacgctgggttggggaatcagctctgcagagtatgacgcgtggctctggcctgtgcctgcatcccctctccactctgtggggagccatgggaggctgtcttatcttgtcttgggcgaccatggagcattaacgctaccaggtcacagtaaggatggcaaagaagccttgatgactgtgacttttctgggtaccagcaccatgagggtcacctgcacacatggtgatgccttagtttctagcctgaagaaggaatgaggtgcttatttattcactaaatgtatttactgaatacctattgagtagtattccaagtaattcagtttctatacttttaataccactcttccctaagatttcattctgtaaaattccaagtacacagcaaagttgacagaattgtacggtgaacacctttaaggccaccacctggattcagtcattgacactgtattatatgaactttatcagatacttattttgagacaggatctagctctgtcacccaggctggagtgcagtggtgtgatctcagctccccgcaacctccaccactgggttcaagcgattctcctgcttcagcctttcatgtagccgggattataggagcacaccactatgtctggctaatttttgtatttttagtagagatggggttttgccatgttgtccaggctggtctccaactcctggcctcacatgatctgcctgccttggcctcccaaagtgctgggattatag

SEQ ID NO: 367333 - DNA, 2611 bp, Homo sapiens
  misc_feature (42)..(42): n is a, c, g, or t
  misc_feature (45)..(45): n is a, c, g, or t
  misc_feature (2506)..(2506): n is a, c, g, or t
  misc_feature (2511)..(2511): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcgaagacctggtcagctccaaggatgacgtgggcaagaacgtccatgagctggagaagtccaagcgggccctggagncccanatggaggagatgaagacgcagctggaagagcatggaggacgagctgcaagccacggagacgcccaactgcggctggaagtcaacagggatcctctagatc

SEQ ID NO: 367334 - DNA, 2728 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgcgtagtcagatcgagccgcgtagtcagatcgagccgcgtagtcagatcgagccgcgtagtcagatcgagccgcgtagtcagatcgagccgcgtagtcggatcgagccgcgtagtcggatcgagccgcgtagtcagatcgagccgcgtagtcggatcgagccgcgtagtcagatcgagccgcgtagtccgatcgagccgcgtagtcagatcgagccgagtagtcggatcgagccgactagtcagatcgagacgcgtagacagatcgaaccgcgtagtccgatcgaga

SEQ ID NO: 367335 - DNA, 2472 bp, Homo sapiens
  misc_feature (42)..(42): n is a, c, g, or t
  misc_feature (45)..(45): n is a, c, g, or t
  misc_feature (2437)..(2437): n is a, c, g, or t
  misc_feature (2448)..(2448): n is a, c, g, or t
  misc_feature (2469)..(2469): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatctgagacncgcgaccagcntgaacacgcgacggatcctcncgt

SEQ ID NO: 367336 - DNA, 2656 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaaccaccaacaccaagaccttcagcttccgtggttttcctaaagcaacatcttgactaccccctgggctgacggcagcggcgatgaagacatgtgtgaaggcggcttcccaaattccaggcgcttccccaaccttcagacagagcaaaccaaattaagctgacataacagctgtgacaaactggctagcaccggggcccagagagttataagggtgaacatcaagagtcaggagcagggtctcacagggtctcaatt

SEQ ID NO: 367337 - DNA, 2624 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaaccaccaacaccaagaccttcagcttccgtggttttcctaaagcaacatcttgactaccccctgggctgacggcagcggcgatgaagacatgtgtgaaggcggcttcccaaattccaggcgcttccccaacctctttatcacccacaaggcacgcttggtccttgcttgagccgttcgtctccccgcctcgatctctgattcttggctgcatccgacgccagta

SEQ ID NO: 367338 - DNA, 1367 bp, Homo sapiens
  misc_feature (42)..(42): n is a, c, g, or t
  misc_feature (45)..(45): n is a, c, g, or t
tcccccccccggccccccccccggctccggccagccactacngcntactactactactaaattcgcggccgcgtcgacccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagaatcctggatcttcttcagggccttgttcttctgagcgattacatcgtcaaaccagagccagggccgcc

SEQ ID NO: 367339 - DNA, 317 bp, Homo sapiens
tgttgaaattagaagtatgtcttattgaccctgacctgtcttcctctccttctaggtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatgtaagcctcacaccttgagtctggagggtagcttgcctggataccagtggaacctgttaagaactcttctctggtcaggacagatttctgctctctgaattccccaccttccattaaa

SEQ ID NO: 367340 - DNA, 382 bp, Homo sapiens
aacccactctcgccctttctcctcttcccacgtacctggaatatcagtgaggcccagggtttccactaagactccaagctccagtttccccatctctaacatgagaatattgagtgcttctgtgcaatctgtctaccctggaggaggtctggaagtaagctgggttctctgtctgcagacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagggctgcacggggccagctccagggagcccctcc

SEQ ID NO: 367341 - DNA, 909 bp, Homo sapiens
ttgccattttattaggttggtgcaaaagtaattaccattttttttaaaaaaggcaaaaccacaattacttttgcaccaatagcacatttgcccttgtttggtctctaaagatggagaccctttggttagcatcctttttatgagtcaagctaatatacccacagctcaactttttgttcttgagcttgaatcacatcactggcaatcggccgtagggttctgctgcttggaccccaaagacaatgacatggaaaaactccagcttaattatgttcttttttgtttgtatatgtaaatagtttttaggaatgtagattattattttgaaatctgtggtaacaaatgtgaaaaccactacattttatttattttcattgaatagcaaataatgttgaagcctgggatctaaaaagttaaatattattttattttgcttaataaagtattggataatttagaaaaagaatttttttttaatgattggatagttaccttattaatggattggtcagggagaaaaagccctgttggatgaaaactgtcatatatgtgacttttaaagtgaaattaataagccaggcatggtgatgttcccctgtaggcccagctacttgggaggctgaagtgaaaggatcacttgagcccaagagttcaagaacagctcggacaacatagcaagacctgtttctctaaaaacaaaaaacagtaaaaatcttaaaaaccgcttaaagatggttggtttcttttaaaaaggaaaaaaaggctcaggtgcagtggctcacgcctgtaatcccaacactttgggaagctgcaggcagatagcttgagctcaggagttcgagaccagcctgggcaacatggtgaaaccccatctttaccaaaaatgaaaaaaaaaaaaaaaaattagcc

SEQ ID NO: 367342 - DNA, 433 bp, Homo sapiens
tttttttcgaaacagagtctctctctgttacccaggatggagtgcagtggtgcaattgtagctcaaagatcgctgcaaccttgaattcctgggctccagtgattctaatgtgtcagcctcccaagtaaactgggtctacagacaaacaccaccatgcccaactaatttttaaaattttgttggagacagggtcttgctatgttgcccaggctagttttgaactcctggcctcaagtgatccttgagcctcaatccccacagcgctcacctccctgggtcactgggatcacaggcataagccaccgcacccagctgacaatactcaaattttgttagtcatatttgtctaatctaaaataatgtcatgaaatgcataaattttaatttaaatctaatcctcctactgggaggtggaagaaaaaaaattttttaa

SEQ ID NO: 367343 - DNA, 718 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgta

SEQ ID NO: 367344 - DNA, 3055 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatatttcttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagagatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcgaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcca

SEQ ID NO: 367345 - DNA, 643 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgta

SEQ ID NO: 367346 - DNA, 3130 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatatttcttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagagatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcgaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcca

SEQ ID NO: 367347 - DNA, 3568 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggtaacttcagggtcccgcccggcggttcacccaagcaagcgcagtttggttccgcccgttccttccatcattgggtagcctttgctgcgctgtgtcacccacgccctctttcccgttgctgaatcttcctcctcccgcgtccccccaccccaactaatgccctgagctctctcggtaggcacgcagttctggccttagattaggtcagggagagggtggcggagagcctctgtctctctgcccgatccctgccttagagtcccaacctgggatatttctgtcgaggaggggactcgttttttgtttcccagggcttttggggcgaccgaagctcgcctgaccttcctaggtgtttcccctaagtgacgcttctaggggaaaatgatgtcggcatttctcgctgaaggccctggggttctcacccaccttggggggaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatatttcttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagagatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcgaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcca

SEQ ID NO: 367348 - DNA, 4048 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatatttcttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagagatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcgaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatccatttgcttttatgtagtttttcttctaaatgtcaacattttgaattaaaatgtttatgattttatatgaggtagaaatcttaactgctttggggtattgttaatagactttttgttatggacagtagtttttaaataaggaaattgccaatttctacagtttgggctctggatttctattgtttgggaaaaaaataactgagtcaagtggtagtaagacaaagttgacattcttagatgagtaactcagtttattacaaggaaagaaaactgattgtttaaggctgatgatcaattcttggagtggtttcagagcccagctctggtcagaagacaatttgaatcttagttcctccactgtgatctccgagaagttacttaataattatattctgctttgtgaaatctggatcatagtacctctttgacagggttgctgtgtgaaccattcattctgcaattagaaaaatagctgtcatgtgctatgcactaggcaaagaagtacctgtcacatgctaggcactaggggaagaagattcggtttctacatttggaaccttagtggaactagaagagacagaagcaagattacagatgagttagagccccccaaggaaacaaacccaggtgatgtgggagagagtaactgggtcaggtgactttttaagggagtctgagctctggcactttttctaagacctgaaggatgagaaggaaacagccttgtgaaaatgattaaatgagctagtatctataaaacatgacagctaatgcctgtcatgtgcaaaaaatggttaactattctaactccgaaaggaattaaacattgttttgcgctttctcctagtccatgttctgctgctgtaacaatacctgagactggataatttatcaagaataaaggttaatttggctcatga

SEQ ID NO: 367349 - DNA, 2617 bp, Homo sapiens
gaagccaagatgagccattgcacccagcctgggtgacagagcaagaccctgtctctaaaaatgaatgaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatatttcttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagagatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcgaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcca

SEQ ID NO: 367350 - DNA, 667 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgaagataatttcaaaacagtgctttctttcccttggtttcatcattttcatatcttaaaccaaattacttcggtatctgacaacagcatcatctacctcagtcattaggatttcttaataaaaaagagattgta

SEQ ID NO: 367351 - DNA, 1767 bp, Homo sapiens
ggatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatatttcttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagagatatataaagataggctatcacccttcttttgctgcagtactaagcatagcaagaaattagaatcatttacattggaaatttgaaaattccctttatatacaccttcggggttacttagcaattctaggcggagtcccaggtgtcgaaagtctcgataaaaatgtgaagagagcaccgtggatataaccaacgggagaagaaagacaatcccacagcgttacccaggaaaactacgagcaacatacagaagagcgcgccacatgggaccgtttttttattaatttgacttaccgatagcgg

SEQ ID NO: 367352 - DNA, 430 bp, Homo sapiens
gagccaggctcaagtattggcaccaagttaggtctcagaggaaagaatggaaaccaatcactttacatttttatttttattttcggtggaaaaatcatccttttttgggacatacttgccccctacttcctcttctctctggaacggctcacaatgagtgtgacattagaaaactccttgcagaggagagtttctccagggcctcctcccaagtgtggctttaaggagtaagcttgaggatgatgttttttaattattgtaaatcattacctcatttccagcctcccaggctccatccatcccagcatcttttattctgccattttcctcaccttgtgctatgacaatggggcgttgtgtttccacagagacttataggagtgttcagtgtatagtttcttaataaacactttattttctaatgaaatga

SEQ ID NO: 367353 - DNA, 1445 bp, Homo sapiens
gagccaggctcaagtattggcaccaagttaggtctcagaggaaagaatggaaaccaatcactttacatttttatttttattttcggtggaaaaatcatccttttttgggacatacttgccccctacttcctcttctctctggaacggctcacaatgagtgtgacattagaaaactccttgcagaggagagtttctccaggctcttcctgggcccttagatctgcagttccgacaagctttggctgcaggaggttttacccatgaactggccatcctactaggaccacaagggaccaagggaatcagggacaaaggcccttcctgccagcccatgatcccgggattggctctcttcccctacttccacttattcttgactctgagaacttttggaacccaatggaatcagcatttcaaggtcaagatgaactgaaggggaagagaagtaaaacttggcctcctccagcccctctcatggcaccaatggaagtgtcctcctgttctctggtcaatatgtgtgtttactttgcttgctttgactcatgccatttactccatggccaccctctcccaaagagggggctcgcttcccccattttcaacttgatccactgaggagagggaagggggtgactttcccttcttcagtaggaaaggcacatttgtagggcctgaaactctcccgtatttgctgactcattggtggagtagacttctggctcccagctccactggcccatggggcctccattgtatcaagtcagcataggctgcccacctaatggtggagagcatgaaactgggagcatcctgtggggggcttgtgggggaaaaaggtggttgttttaacccaccgttgttttggggtggtgttgcacactagtagagaatagagtctatgcctttggcaaatttaactgggagtttggattcccacttaagggttttacttcttgggtcctgtggatggtggttcttcgtgtcaggatcccagcccgattctgcaaatgcctccatggggtttaaaaacatgaggctttccaagttcttgcccagtatctggggcagcctccagagtatcacctgggagttcaggttctctccagggctccaggtgtgtgtttatctcgccccctccagctctcctcatcctgctccccattgctccatgtcaggctgttccccattgtgccctgctgatgctttgggtccagggcctcctcccaagtgtggctttaaggagtaagcttgaggatgatgttttttaattattgtaaatcattacctcatttccagcctcccaggctccatccatcccagcatcttttattctgccattttcctcaccttgtgctatgacaatggggcgttgtgtttccacagagacttataggagtgttcagtgtatagtttcttaataaacactttattttctaatgaaatga

SEQ ID NO: 367354 - DNA, 1323 bp, Homo sapiens
cacactcattgtgagccgttccagagagaagaggaagtagggggcaagtatgtcccaaaaaaggatgatttttccaggctcttcctgggcccttagatctgcagttccgacaagctttggctgcaggaggttttacccatgaactggccatcctactaggaccacaagggaccaagggaatcagggacaaaggcccttcctgccagcccatgatcccgggattggctctcttcccctacttccacttattcttgactctgagaacttttggaacccaatggaatcagcatttcaaggtcaagatgaactgaaggggaagagaagtaaaacttggcctcctccagcccctctcatggcaccaatggaagtgtcctcctgttctctggtcaatatgtgtgtttactttgcttgctttgactcatgccatttactccatggccaccctctcccaaagagggggctcgcttcccccattttcaacttgatccactgaggagagggaagggggtgactttcccttcttcagtaggaaaggcacatttgtagggcctgaaactctcccgtatttgctgactcattggtggagtagacttctggctcccagctccactggcccatggggcctccattgtatcaagtcagcataggctgcccacctaatggtggagagcatgaaactgggagcatcctgtggggggcttgtgggggaaaaaggtggttgttttaacccaccgttgttttggggtggtgttgcacactagtagagaatagagtctatgcctttggcaaatttaactgggagtttggattcccacttaagggttttacttcttgggtcctgtggatggtggttcttcgtgtcaggatcccagcccgattctgcaaatgcctccatggggtttaaaaacatgaggctttccaagttcttgcccagtatctggggcagcctccagagtatcacctgggagttcaggttctctccagggctccaggtgtgtgtttatctcgccccctccagctctcctcatcctgctccccattgctccatgtcaggctgttccccattgtgccctgctgatgctttgggtccagggcctcctcccaagtgtggctttaaggagtaagcttgaggatgatgttttttaattattgtaaatcattacctcatttccagcctcccaggctccatccatcccagcatcttttattctgccattttcctcaccttgtgctatgacaatggggcgttgtgtttccacagagacttataggagtgttcagtgtatagtttcttaataaacactttattttctaatgaaatga

SEQ ID NO: 367355 - DNA, 1196 bp, Homo sapiens
gagccaggctcaagtattggcaccaagttaggtctcagaggaaagaatggaaaccaatcactttacatttttatttttattttcggtggaaaaatcatccttttttgggacatacttgccccctacttcctcttctctctggaacggctcacaatgagtgtgacattagaaaactccttgcagaggagagtttctccaggctcttcctgggcccttagatctgcagttccgacaagctttggctgcaggaggttttacccatgaactggccatcctactaggaccacaagggaccaagggaatcagggacaaaggcccttcctgccagcccatgatcccgggattggctctcttcccctacttccacttattcttgactctgagaacttttggaacccaatggaatcagcatttcaaggtcaagatgaactgaaggggaagagaagtaaaacttggcctcctccagcccctctcatggcaccaatggaagtgtcctcctgttctctggtcaatatgtgtgtttactttgcttgctttgactcatgccatttactccatggccaccctctcccaaagagggggctcgcttcccccattttcaacttgatccactgaggagagggaagggggtgactttcccttcttcagtaggaaaggcacatttgtagggcctgaaactctcccgtatttgctgactcattggtggagtagacttctggctcccagctccactggcccatggggcctccattgtatcaagtcagcataggctgcccacctaatggtggagagcatgaaactgggagcatcctgtggggggcttgtgggggaaaaaggtggttgttttaacccaccgttgttttggggtggtgttgcacactagtagagaatagagtctatgcctttggcaaatttaactgggagtttggattcccacttaagggttttacttcttgggtcctgtggatggtggttcttcgtgcaaatagtgcttatagtttaaaagtcctagaaaagattcacagtcacattttctgtatgtaactacatttactgtaagtgaaacttggtagtttgttggcttgttcatttttatttttcaagtcttgtgtaaacgtaaagcaccttgatctgccagcatggtcaaagagattggccatagaagattcaccatagtagacaaccatatctacatg

SEQ ID NO: 367356 - DNA, 4345 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367357 - DNA, 1493 bp, Homo sapiens
gctggcaggtggtgatggagaactgcgggcactcgcgccagccaacactggcctcctggagactggtcaccacacagctgttctgaagggcccgcagggcttaagggaggaaagcggcttcccacaggggctctgtgggttcttttggggagaagagctgcccctcaagtagaggctggagttgttcctgcagagtggagagaggagagaaagactggatggcagggaggcctttcccagcaccaggagtgcagtcaacggagtagtcaggtggggacaactatgagtcacttctccctggcgatcttcatagcctgtttccacacccttagctggagtccagatgtcctggcttctggggctcaccctcgcccacccacctcattcacagccatgctatgtcacactgtggggatcccatccatccctgcttctccctgccccggcctatcttgggtaccatccttctcttgccaacctaggaactaagcaggtgaacccaacctggcgtcattctcgggatccatttcctcctgggatatttggggatgtgtatgcccaggcccttccttccttggtggcaatggagcctagccattagggccagcgggagtctgtgacccaggtactggcacccaaagtgactttgccctgcttcctgccatcttgttaaagaaaaggtagccaggattccctaggaaataagctgtggagaaaccactcagcaactgcagacaggggtctgtggccagttcagggtctgagggccagtgaaggtgggtgcaggcaggctgaaaggacaccagcacagccctcggggtgggggcttgtcactggtgtctggtctccctgcttttcccatgtggcctgggctccatgatacgttctccaggcctgggcctggaaaacaggtctttcctgttttctggacctgctagaaagcttcagtcagtttggtccctgggagagaaaacgctcttcccatgacggctctgtggaggccaggaatggggtaggtgggttgactgggagtactccttcctgccgccctggtcaagggactagtgtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttttatttttttcttgaaacagggtctcactctgtcgaccaggctggagtgcagtggtgtgatcatggctcacttagcgtctacctcccgggctcaagcgatcctcccacttcagccccctgagtaggtgggac

SEQ ID NO: 367358 - DNA, 4291 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367359 - DNA, 4202 bp, Homo sapiens
gctggcaggtggtgatggagaactgcgggcactcgcgccagccaacactggcctcctggagactggtcaccacacagctgttctgaagggcccgcagggcttaagggaggaaagcggcttcccacaggggctctgtgggttcttttggggagaagagctgcccctcaagtagaggctggagttgttcctgcagagtggagagaggagagaaagactggatggcagggaggcctttcccagcaccaggagtgcagtcaacggagtagtcaggtggggacaactatgagtcacttctccctggcgatcttcatagcctgtttccacacccttagctggagtccagatgtcctggcttctggggctcaccctcgcccacccacctcattcacagccatgctatgtcacactgtggggatcccatccatccctgcttctccctgccccggcctatcttgggtaccatccttctcttgccaacctaggaactaagcaggtgaacccaacctggcgtcattctcgggatccatttcctcctgggatatttggggatgtgtatgcccaggcccttccttccttggtggcaatggagcctagccattagggccagcgggagtctgtgacccaggtactggcacccaaagtgactttgccctgcttcctgccatcttgttaaagaaaaggtagccaggattccctaggaaataagctgtggagaaaccactcagcaactgcagacaggggtctgtggccagttcagggtctgagggccagtgaaggtgggtgcaggcaggctgaaaggacaccagcacagccctcggggtgggggcttgtcactggtgtctggtctccctgcttttcccatgtggcctgggctccatgatacgttctccaggcctgggcctggaaaacaggtctttcctgttttctggacctgctagaaagcttcagtcagtttggtccctgggagagaaaacgctcttcccatgacggctctgtggaggccaggaatggggtaggtgggttgactgggagtactccttcctgccgccctggtcaagggactagtgtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367360 - DNA, 4369 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgaaaaaaataagtacaaagtgaatgg

SEQ ID NO: 367361 - DNA, 2993 bp, Homo sapiens
aaactgtcaacctaccaaaaaacgataatgtggcttatgggtattgctgtctcattcttggtatattcttgtgttaactgcccatcggcctgaaaatactcattgtaagcctaaaaaaaaaatctttcacactgttttttctgcttgttgtaagaactaaaatgagcctcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367362 - DNA, 4641 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgacgatgacagctgtgtctttccttctgagcctgccttttctcccccccaccgagggggtgtccctcgttgaacaatactcccgcgggaggtcgccccttgtggcttgtacgccccttagtgactcttgacaggtggtgccgccgctttaagggcggcgcatatccatcaccttagactttggctccctgtttgccataattcccggttcgtggtaccactccgcgcactgttgcctcctctggggagaggacccccccctttgggggggggcgcctactcgggccactccccccaga

SEQ ID NO: 367363 - DNA, 2897 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaacagatcagatataggagcacaccagccgggcatgagcctctccagctctaaggtgatgatgaccaaggccagtgtggagcccttgaactgcagcagctggtggcccgccatacagtgctgcagctgcctggtcagggatgcgacgtggagggaaggattcctctgaggcagcagctccaacacatggggccagctcaggaccaccagggcatggaactggagaccatggtttttaatgttagaacagaaaacgccatacttttcctatatcaatgatcaaaagtgcaaacaatttaaatttccatcagggaacatcaaatgttgcccaacccttttcattcctatccatggctccgtaaggggcttgaggcttaatgcccatcctgtggccaagctgagcttccactccgggaccaaaaaaaaaaaaaaggtctgctttgtgacatcatcgttatgagcggaaagtacctagatgacaatgtttccattctgaaaaatagaaacatactattcaagaccaaggtagcagaaaagttacttgtatctgcttatcataagacgaaactctgcaacttggcaacggtggccagttttcgtaatgaaacagtctttagtaatttaatcttcatgcttcataacaaaccaaaaccccatgagatttccacatggcataattttgccttactaacagaatcatatccttaaggatgaccatcattcccccaactaaaacaaatacaaactaatgtatgatatttttttaagtgccagatcaatatggtctaaagcttcaataaggattgtgtgtaggtgaataaagacagctaagtgaatgtgtgtaaagtgtagcaaaagcagacagatatttatgtacagtattcatagaatggaaagttaaatatttttgcagtgtgtatttaaaagagaaactcaccataatagtgccgtctaaaaatctttgtaaagttaatttaatgtcctttagaagtgggagtctggtggaactgtgttggatttaagataccttttcactcttccgtatgtcatgagccttgtgcgtcacctcactgtggtgcatgtgcaagggcgtgtgcacgcctgtgctttgccatcccatgttgtaaacagctgttccaaaggcacaaacgagtttagggtagactctgtaaacacctccttactcactatagtcaagaagtccagcggcgtcccaatatagaggtcccagtgcagtctgtccagaatagccagctccatcctcagcagctcattcggggaatagtcagagccatagtgctttgtgaagtcttttacttgtggaataaactgtaaaaagaaaataaagaggccaaagccctacatcaaaaaaaata

SEQ ID NO: 367364 - DNA, 1938 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgaca

SEQ ID NO: 367365 - DNA, 2789 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaacagagaggagcggacaacagcagcacccggagacagcagcagcgacgaacaacagccaccacacgccaccgacgacaagcgagggcacacaaaggaaagagcgaaacaagaccgacacgggcagaccacgaaagagagagacagagcacaaaacgggggcacacacacaaaacaacagagacaaaagaaacacgggacagacacgtgggacaaaatgacgagcgcacgcaacgacaacacgcaagccaagcagacacacactcgcaggagaaccaacaaacgaaaacacacggtagagacagagcaacatagacgacgaaaacaagacacacgaacgaccgagaggcaaacgaggaacaaacgacggacgagcactcgcagcgagaagagaccacgagagcaacagagacacctagacgcgaaggaggcagcaagaagaaaggaaagaagccgagcggagagaaagaggaagaaaccaacga

SEQ ID NO: 367366 - DNA, 186 bp, Homo sapiens
catgcgtgcgcctgcggccccagacctatgacctccaggagagcaacgtgcagctcaagctgaccattgtggatgccgtgggctttggggatcagatcaataaggatgagaggcaagaggcgggaagggcggccccacccagcctcctcccaccccacctacattggcccctataacagtagccca

SEQ ID NO: 367367 - DNA, 4077 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367368 - DNA, 3064 bp, Homo sapiens
ccggccctctgctttcagtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcgaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367369 - DNA, 1261 bp, Homo sapiens
gatgcttcagtgagggtatctaaaaaggtaaactggcatatccagggcaaatgtgggctgccaatggctcatctctagggtaattttatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttga

SEQ ID NO: 367370 - DNA, 2206 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgaca

SEQ ID NO: 367371 - DNA, 1575 bp, Homo sapiens
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaagtaggtggcagctgcgcctgcgctggctcctcttgctcctgtgggctcttg

SEQ ID NO: 367372 - DNA, 434 bp, Homo sapiens
tatcatgaaccagaccctagcagtcacttacaaatacagttgatcctcattatttgtggatcctatatttgcaaatttgcttacttgctaaaatgtgtttgtaatctccaaattaatacttgtggagctttcaaggtgattcatggacatacacacagtagtgaaaaatctgtcactccttatgcacgttccaagctaaggtcaaataaggtgaccctgggcctccttgtttcagctctcatacaaagatgacccaaggacagaggcaacagagggcagtgcagggtagtgcaagaagctctggctctaggactaattggacgaggtctgaatcttaactctggcacctgttagtgaagcagcctcaagcaaatcacttaatgcttctgtacttcctttattgttttgtaaataaagaaaattcaatctacaaa

SEQ ID NO: 367373 - DNA, 2063 bp, Homo sapiens
ggagggttttgctctttgtgtgggtgtgtgagtggctatgatcctagttgtccagctgctgcgtggagaataagtaaagcaggtctgaatgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcatgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagca

SEQ ID NO: 367374 - DNA, 1078 bp, Homo sapiens
  misc_feature (1076)..(1078): n is a, c, g, or t
cgcgcccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggtggggaaactgaggcacggagcagctgatgcccaaggtccagcagccatgctggtgggctggggaggcgctcagactccaagccaggcaggccgtgggtccggccgccccacagctggtaatgctgcacctccctctcctgtgatgtggccccaggccccgaccccgctcaggggtggtgggaagagtcctggagagcaggagcagtgccggagcccccactgcagctggtcccagcccctgcagagatccagacgcttgttttttaaatacagcagctctgcggtgcttttccttcctcaaaaaaaaannn

SEQ ID NO: 367375 - DNA, 1729 bp, Homo sapiens
  misc_feature (1)..(1): n is a, c, g, or t
nctaaagccaattatggacaacctccctttattctctgacaacataattcctcctggattaacacacagaaaaatggcagagccattagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcatgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagca

SEQ ID NO: 367376 - DNA, 2152 bp, Homo sapiens
cgcgcccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcatgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaatcctgggggtcctggtcttggctggaggtggggcctaagccccagggcagccagggtcaggagaggcacacaggtgaaggggaggcttggccttggg

SEQ ID NO: 367377 - DNA, 267 bp, Homo sapiens
aggggagcgcgggaatcaccaggctgaagaatgactggaaatgggaccctctccaaccaaagcacccagacattccggcgccggacatttcaaagagcgcggaagccacgccttcccccagaaccggaagctttgcaactagcgcctcttgtagactggctgtttataagggggcggggggccacagcagaggctactgcccttgggaggcactcatgaaggtgcctccatctctcccttccccaatatacctgatggtcaactctc

SEQ ID NO: 367378 - DNA, 1416 bp, Homo sapiens
tacagcggctggtacggcccggagtgtttgggatgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367379 - DNA, 1785 bp, Homo sapiens
tacagcggctggtacggcccggagtgtttgggatgcggccgggttccttccgcgggacgggtgagggcgctggggccctgggcagcgcgggctcgatgtgtgtcagccaagtagctggtcccactggagcggtgaggtcgccaccggatagtgttcctgccccattactagcgatctgtgaccttgggccagtgattttactgagtcttgcttccctcatctttaaaatgtggctaatgcctgccttagggaaccgttgtgaggattaagtgagacatggtatataaaacgacctccttctggcataaacttgaggtggaagataccttgaggatgcttgaaggtctgctaggcagcttcacagccttttctttcctcttctctatcagaggtctctttggaagcaataatgatgactataacaagaacttatcttgctttgcaagattcttccgccgtcagagtttctgatttattttctggggttccatgtatgccagggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367380 - DNA, 2021 bp, Homo sapiens
agcgcggaatttccggtttccggcgagagggccagagtgagtgtttacaccggcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctcaaaaaaaaaaaaaaaaaaaaaaaaaaaaaaaaaaaaaaaaaaaaaaaaaaaaaaaaaaaaaaaaaaggggggggggggcagcaataagaattccccccggaggggcgcgccacatttatacggcgcctccccacagttttttgtggaccaaagggggccccaaattaggggacagcggcttttattaaaaccttagtcgacaggcggcggcggcgtcttttaaaaagctgtgtagagcggggagaaaaaccgctggtacctgctggggccgcaccttctgcggggagacgacgacccctattattctctcgcggggggggcagcgagacaccaaattgtgggcggacacacacactctcacccccccaagaagaattttaaagacgccgccccacgggaggcggacataatataaaacagagttttacaacgacggccgactaatcagcggggtggtacaaccacaacccggccggctagatattagtattcgctcctggtgaggaacaaacactttcgcgcgcccactacgagcgagatatcgttatcttaggacagcacgcaatttttcccccgggg

SEQ ID NO: 367381 - DNA, 1430 bp, Homo sapiens
tacagcggctggtacggcccggagtgtttgggatgcggccgggttccttccgcgggacggggatgaagaaactgaggcctagagagctgtccatcacagtatgagtagagagagaaccccagattctagttctggcctcctgatgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367382 - DNA, 1329 bp, Homo sapiens
agcgcggaatttccggtttccggcgagagggccagagtgagtgtttacaccggcggcagtgcggccgggttccttccgcgggacggggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367383 - DNA, 1151 bp, Homo sapiens
agcgcggaatttccggtttccggcgagagggccagagtgagtgtttacaccggcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367384 - DNA, 951 bp, Homo sapiens
  misc_feature (910)..(910): n is a, c, g, or t
agcgcggaatttccggtttccggcgagagggccagagtgagtgtttacaccggcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccagtncacaccctctagcagttctctctcctgcagggatcctctag

SEQ ID NO: 367385 - DNA, 1360 bp, Homo sapiens
tacagcggctggtacggcccggagtgtttgggatgcggccgggttccttccgcgggacgggtgagggcgctggggccctgggcagcgcgggctcgatgtgtgtcagccaagtagctggtcccactggagcggtgaggtcgccaccggatagtgttcctgccccattactagcgatctgtgaccttgggccagtgattttactgagtcttgcttccctcatctttaaaatgtggctaatgcctgccttagggaaccgttgtgaggattaagtgagacatggtatataaaacgacctccttctggcataaacttgaggtggaagataccttgaggatgcttgaaggtctgctaggcagcttcacagccttttctttcctcttctctatcagaggtctctttggaagcaataatgatgactataacaagaacttatcttgctttgcaagattcttccgccgtcagagtttctgatttattttctggggttccatgtatgccagggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgcctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367386 - DNA, 1237 bp, Homo sapiens
tacagcggctggtacggcccggagtgtttgggatgcggccgggttccttccgcgggacgggtgagggcgctggggccctgggcagcgcgggctcgatgtgtgtcagccaagtagctggtcccactggagcggtgaggtcgccaccggatagtgttcctgccccattactagcgatctgtgaccttgggccagtgattttactgagtcttgcttccctcatctttaaaatgtggctaatgcctgccttagggaaccgttgtgaggattaagtgagacatggtatataaaacgacctccttctggcataaacttgaggtggaagataccttgaggatgcttgaaggtctgctaggcagcttcacagccttttctttcctcttctctatcagaggtctctttggaagcaataatgatgactataacaagaacttatcttgctttgcaagattcttccgccgtcagagtttctgatttattttctggggttccatgtatgccagggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgcctgctgggccccggcccatcacccagagtgagctggccaccgccttggccctggccagcactccggagagcagctctcacacaccgactcctggcacccagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367387 - DNA, 321 bp, Homo sapiens
agctttgctgaggactcccccatcttcctttccttccccggaaagcacagacctaagtgagtcttcactggatcccagctaacagcttctgcccattcctatctttccacagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgc

SEQ ID NO: 367388 - DNA, 1442 bp, Homo sapiens
agcgcggaatttccggtttccggcgagagggccagagtgagtgtttacaccggcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367389 - DNA, 1371 bp, Homo sapiens
agcgcggaatttccggtttccggcgagagggccagagtgagtgtttacaccggcggcagtgcggccgggttccttccgcgggacggggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367390 - DNA, 1527 bp, Homo sapiens
tacagcggctggtacggcccggagtgtttgggatgcggccgggttccttccgcgggacgggtgagggcgctggggccctgggcagcgcgggctcgatgtgtgtcagccaagtagctggtcccactggagcgaggtctctttggaagcaataatgatgactataacaagaacttatcttgctttgcaagattcttccgccgtcagagtttctgatttattttctggggttccatgtatgccagggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367391 - DNA, 1247 bp, Homo sapiens
  misc_feature (1037)..(1038): n is a, c, g, or t
  misc_feature (1054)..(1054): n is a, c, g, or t
agcgcggaatttccggtttccggcgagagggccagagtgagtgtttacaccggcggcagtgcggccgggttccttccgcgggacggggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagaccagggtcattctcaggactcacaatgtctcttgtgtcnntcggagccatacatgnttttagcaggcctagaggcctagcctgggccgcttgagccgtgggccgtgtggtaggatggtccgggagtgtctggcccggccgggagaccaccgggactttgggcccgcctccgccccggagcgggggggggcccctcggtaaagggggggcgcgcgttgtaggggtgtgcgtgtgtttttttttgtatgct

SEQ ID NO: 367392 - DNA, 1378 bp, Homo sapiens
actatgaaaatgctttaatggtggtgtctgtacagcatggatgtggacagggaaaacagcaagtgcacacagtgggacaggccacaggacaggctgggagtgaataaagagttcacactgcttccctgctttccccagtgactgaaggctctaggccacctcctcctcagcctcctcctcgaactcgccctcctcctcggctgtggcatcctggtactgctggtactcggacaccaggtcattcatgttgctctcggcctcggtgaactccatctcgtccatgccctcgcccgtgtaccagtgcaggaaggccttgcgccggaacatggccgtgaactgctcggagctcgtgccgaattcggcacgagtctctctctctctctctctctctctctctctctcctcgggccgctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367393 - DNA, 613 bp, Homo sapiens
aatctgttcgtcctcctccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 367394 - DNA, 824 bp, Homo sapiens
tacagcggctggtacggcccggagtgtttgggatgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggtaagtgcaggactgaatttgaggaaataggagttgtcggaaaaggagaaaacaggagaagacaattcctctaaagagacttggactatcttttgaagaatgactggtcttgtgggaagagggagagtaatcaaggtgtgtttgatatccccagccctttaagagctctcagtcccacagagagataatggc

SEQ ID NO: 367395 - DNA, 1603 bp, Homo sapiens
acagtgagaatggggaaagtcagctaagtgacaagcagttgttgaaacaaatacttgatcagaatggtggaagtgatatgggctaggagcaactaagagagtcatttcaaggtaaataggatttgtggccgccctgtaagaacacccacacaaagcccccgttgttcttttgatcagagcaaagagaagcatggaatgaagaccaccacaaggaacagtgaagagacgcttgccaacagaagaaaagaatttatcaacagccttcgactgtacaggtcattctatggaggtctagctgatcagctttgtgctaatgaattagctgctgcagatggacttccctgctggaatggagaagatatagtaaaaagttatactcagcgtgtggttggaaatggaatcaaagcccagtctggaaatcctgaagtcaaagtcaaaggaattgatcctgtgataaatcagattattgataaactgaagcatgttgttcagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattctattatattcaaaatgcatctttggtattgtgcctctgctcccatctctctctttgcctcatagatttagctatgttgggaagcacatgcttgctctaggaatatctccaataaagctgttaactatttggtgg

SEQ ID NO: 367396 - DNA, 2905 bp, Homo sapiens
aggcggcggcgagccgagccgggcggcggcggcagtggcggcagtggcggcagcggcagcagttgcagcagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggacctgatcttcaggtttgcatatccaaaaagcctacatgttgcaccaggaagatggaggagagatatcagattgcggctcgccaggatatgcagcagtttcttcaaacgtccagctctacattaaagtttctaatatctcgaaatgcggctgcttttcaagaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaaataggatttgtggccgccctgtaagaacacccacacaaagcccccgttgttcttttgatcagagcaaagagaagcatggaatgaagaccaccacaaggaacagtgaagagacgcttgccaacagaagaaaagaatttatcaacagccttcgactgtacaggtcattctatggaggtctagctgatcagctttgtgctaatgaattagctgctgcagatggacttccctgctggaatggagaagatatagtaaaaagttatactcagcgtgtggttggaaatggaatcaaagcccagtctggaaatcctgaagtcaaagtcaaaggaattgatcctgtgataaatcagattattgataaactgaagcatgttgttcagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattctattatattcaaaatgcatctttggtattgtgcctctgctcccatctctctctttgcctcatagatttagctatgttgggaagcacatgcttgctctaggaatatctccaataaagctgttaactatttggtgg

SEQ ID NO: 367397 - DNA, 931 bp, Homo sapiens
ggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgcctttgtgagtatcaatttacccagctgatgatg

SEQ ID NO: 367398 - DNA, 356 bp, Homo sapiens
cagtgagctatgatcacaccactgcactccagcccagtcaacagagtgagaccctgtctctaaaacgtgtgtatatgtatgtatatttttctttttttagctgaaataaaacaaggacacttgggaagaatacctacgtgattattatctacaataattattttcttcaccttactgtgttaagagtttcattcacttttattttttctccaggaacagattatggcctttgcaagcaaatgagtactcctctcctaaagaaagattacgttgatgaaaaagaacatcctgcccaggacccatcatacatattttcaagatcttatttaatttaataaacttactttacattaaaa

SEQ ID NO: 367399 - DNA, 443 bp, Homo sapiens
tgtaaaatccatggaacatctttagtacattgtaggtgctcaacaaatactaataattctggagtagacacagcctttggataatatgggtaccagtattacttttggagcctaaatgacactcaaagcctgctaccttcacaccaaagactccactgctctgtagtagcaacaagaataaagggaactgaacatactgaaatggattccgagataaatggtgaacactaccctactctgggccatttagtatatattcctggcacaggtctaggtcctctgcagtgcagtcattcaccattaattgtcctttctatgtagcaggctctggagatactgagaacagtctccgctttcaggaagttcatagtcaagtaaggaagaccgtaaatgacaatctccgtacagtgatagaagtatgcataggatgctgtggaagcata

SEQ ID NO: 367400 - DNA, 4186 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367401 - DNA, 3888 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttgaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367402 - DNA, 4634 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367403 - DNA, 3707 bp, Homo sapiens
cggaaaccgggccgcggaggcacgatgagagccgtgagagccctagcacgacttgcccaaagacaatttctcaggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367404 - DNA, 3309 bp, Homo sapiens
ttagcctaagctttggttacaaacaaggtttctttattgaatttttaattccctgctactcacatttcaccttgtttgtcttgtggctgatgctgctcagtggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367405 - DNA, 2691 bp, Homo sapiens
cagtgagctatgatcacaccactgcactccagcccagtcaacagagtgagaccctgtctctaaaacgtgtgtatatgtatgtatatttttctttttttagctgaaataaaacaaggacacttgggaagaatacctacgtgattattatctacaataattattttcttcaccttactgtgttaagagtttcattcacttttattttttctccaggaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367406 - DNA, 3439 bp, Homo sapiens
tgtaaaatccatggaacatctttagtacattgtaggtgctcaacaaatactaataattctggagtagacacagcctttggataatatgggtaccagtattacttttggagcctaaatgacactcaaagcctgctaccttcacaccaaagactccactgctctgtagtagcaacaagaataaagggaactgaacatactgaaatggattccgagataaatggtgaacactaccctactctgggccatttagtatatattcctggcacaggtctaggtcctctgcatatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggtaagacgataacagagcagggccactcccttctcactttgctgccagaggtcacacctgaactctgctttattcttagggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367407 - DNA, 1599 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagtaagaggttgctcagaggaatgactttgcaaacagctcttaatttcttttgcttttttttgaaacagaaggttgcagtgagccgagatctcaccactgcactccagcctgggtgacagagcaagactctgtctca

SEQ ID NO: 367408 - DNA, 709 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaagcaatattgtttctgattggagtgatgtttccctcttggttt

SEQ ID NO: 367409 - DNA, 1606 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaa

SEQ ID NO: 367410 - DNA, 3941 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367411 - DNA, 3658 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattgggaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367412 - DNA, 3887 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggaacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367413 - DNA, 3887 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttataaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367414 - DNA, 3021 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagatgcattctaactccacgaacttacctattttgttaaccttgattggttacttctcccagaaggtctaatcaag

SEQ ID NO: 367415 - DNA, 3455 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgcctttgaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367416 - DNA, 3925 bp, Homo sapiens
ggggcagtctcttttctctcctcacctgacggctcccctccgcgcctccgggggctccctcaggcctccccacggtcatttcagctggacagaggcagcagcgacagtgacagcgatagtggcagcagcggtggcagcgagagctatgcggggccagggtccacccctttctagctttggcgtctggttggcttccagggcagcctccgatccatcccgcccgaggaggcaaggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367417 - DNA, 4309 bp, Homo sapiens
gtaagaaagagtgcctctgacagagttcactgagaacttcaatgtctttttttgacattgagttatctctgtggcttctgtcatttattagctcagaccacagcattaattactgatttttttaatcttaaatgacaagacactgctgtcctgggaccttgctttaggtttagttatggctttttcctcagcctatgtggcccacctttctaattttttttcctctcttttgacctccccagaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367418 - DNA, 4575 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttggtagttgaagattcttattttgctaggggtcttgtatatctacatcttatcctagattctagggactctggttttcgatttaagctatagtttaattttaggcaaaacttttggttatgaggaccagtacctattcaggccagctcaagtggagatggtctcatcgtaaatcctgtacagggagcaatctcatgggccgtcttaggttgtgaaataacagatagctgggcctcacaggacaggcaccagagtgttgggaatggaggctgttctttccctctgaggagtctgtggtcattgatctcttgcctctcatttttctcctttctgctcacaagcttccctttttgcatggtagccattcctaaccctacatcagaactattcagctccagtgtgtgccccatactgaaactttccttattgctctctagttcaaatatcaggagggcctggctgagtttaactcatggctggcacctgttcagtcatgtccagctttggctctgttggctgaggctgatgtgacagtgcaggggctccacctctaggggctgtgagtgaagcaggcctgatggaattatcctgccacacaacaatcagagctggaggaaactttagggagcagagaaaaacttctgaagcagtttatgaagaggctggaagacttagcaggctcatgtgtccatgcagataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367419 - DNA, 1995 bp, Homo sapiens
cgggacgggattggagtgctctgctccggacgcactacgtaggtgggcctgcgggagttctgagtgcgacggcgcaggtctgcaccatggcggcccggcttgtcagccgatgcggggctgtgcgtgcagctccccacagcggcccgctggtgtcctggcgcaggtggtccggcgcctcaacagacaccgtgtatgacgtggtggtgtcgggtggaggcctggtgggcgctgccatggcctgtgccttgggatatgatattcactttcatgacaagaaaatcctgttgctcgaagcaggtccaaagaaagtactggagaaattgtcagaaacttacagcaacagggtcagctccatttcccctggctctgcaacgcttctcagtagttttggtgcctgggaccatatctgcaacatgagatacagagcctttcggcgaatgcaggtgtgggacgcctgctcagaggccctgataatgtttgataaggataatttagatgacatgggctatatcgtggagaatgatgtcatcatgcatgctctcactaagcagttggaggctgtgtctgaccgagtgacggttctctacaggagcaaagccattcgctatacctggccttgtccatttcctatggccgactccagcccttgggttcatattaccctaggtgatggcagcaccttccagaccaaattgttgataggtgcagatggtcacaactccggagtacggcaggctgttggaatccagaatgtgagctggaactatgaccagtctgctgttgtggctactctgcatttatcagaggccacagaaaacaacgtagcctggcagagatttcttccctctgggcctattgctctgctcccgctctcagacaccttgagttccttggtttggtccacgtcccatgaacatgcagcagagctagttagcatggatgaggaaaaatttgtggatgccgttaactctgccttttggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaaaaaaaaaaaaaaaaaaaaaaaaaagggggggggggctaagaaatttccccgggggggcccaattttggcggtcacccccgctttctttgggctcccacggggtccccctatggggagcgcgtatataaataacgcattggccacaggcgccgcgggtttcaaaccccgctcgttggccgggcggaaaacccggctccccctggcactcctcggggaagggacccttaactctgtgggcgttggcgccatctgtggcaccacctcccctcagagaatctatcgcgccgagggcaaatataccctctcacccgctcttcaccgggtacccaccgcccattatgtcttggcgcttgaaactttgggcacgcgcctctattctcacactcttc

SEQ ID NO: 367420 - DNA, 3230 bp, Homo sapiens
ttagcctaagctttggttacaaacaaggtttctttattgaatttttaattccctgctactcacatttcaccttgtttgtcttgtggctgatgctgctcagtggagtgatgctgaccacacggacttcatcgacacagctggtgccatgctgcagtatgctgtcagccttctgaagcccactaaggtctcggctcgccagctgcccccaagcgtagccagggtggatgccaaaagccgagttctgtttcctcttgggttgggacatgctgctgagtacgtcaggcctcgggtggcgctcattggggatgcagcccacagagtccatccgcttgcaggacagggtgtcaacatgggctttggggatatctccagcttggcccatcacctcagtacggcagccttcaatgggaaggacttaggtaaggattcagatactatggggaagtatccagaggtcatatagttaggcaagatcagggcccacagtagcaagagggagtggacataaaatatatctggcttgctaggagatggaagaaaaccttattattggattagggatttaatctttcctctgcccttcaggttccgtgagccacctcacaggttatgaaacagaaagacagcgtcacaacactgctcttctggctgctacagacttactaaaaaggctctattctaccagtgcctccccgcttgtgttgctcaggacgtggggcttgcaggccacaaatgcagtgtctccactcaaagaacagattatggcctttgcaagcaaatgagtactcctctcctaaagaaagattacgttgatgaaaaagaacatcctgcccaggacccatcatacatattttcaagatcttatttaatttaataaacttactttacattaaaattctctttttcttctttgcttaatgggcctgtggcacccaaataatgaatgataatttgctgtgaggagcgtatattagccagaccaaaggaaaaaacttcgaaggaagacttacaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367421 - DNA, 2530 bp, Homo sapiens
ttctgtcttgttgtctttcacccgtcgggggcgcgttttattcgctttgctgggctccgtgtggtaagtccccgcttttgcctctgacgtcccttctggggttgtctcaaccccgtcggtgtccccgcccgccggtttttatattggggagaaaccaccgcctgtctatgccccgggtttctctctggggaccgcttaggcccacggtcaccttaccctactgggccgccccgcgccccaaccgaaggtgtttaaaaacttttccggggcccgggcggcccccaaattttttttttttttttttttttttaatttggttgaaaagagctttttattactaaaaaacccacaaggtgctgtctcactcatttccagttaatcatttctaaagagaaaatttacattttgtttttgttttaatgttggtcataaatttatacagttgttttttgatagaggtaagaattagactcgatgcatttttgttagaattgctgtttaaatgttaacatcagaatgcaaattaaatataaattgctttaacctttgttacaggtatactggactttctgaaaggaaaaccaggtctcattaatgctagttattactttatcacagcaccagatttccattttatttatggttcctctctgggacaccactgtcggtttaataaaacaataaataattcattgcacagatccgaagacctcaggaaccagatcacaagggaaaccgattagcagcagaatttgttcatgtttggtggcagactggtggccaactggagggaggggagttttactgtgggtttttgaagaggtctcgtcacaagaccagagatgcctcttgaagagatttttaggttgtaggtttgcttactctaaagaacatcttgcccagaagtctgatttgagatgaaatgaagagaaacagtctgcttttgaaccaagtaaggtattcttgggaataatttttagagccatgagaaatctattcttacaggggtgcttttcaggcaaatgcagaaaatttaaaagagtctagaacaaaaaagtgacaatgtcacaaccttgctggaatctcaggaaaaagaattaaagatggcagctgctgtgaaaagctgtgtgactcctggcggagactgcagggacaaggtcatctttcacaaaaaatggaaaggtggcctagatgaggaggacacagactctccagaagttatgcaaacaaaatcaggcaagatgaagaattttaaggcacacctccattggcccacagagagtgttcttcatatgacaatgatgttaaacaccatctgtcacgtaccaggccatgtcctaagtattttaaatatgttaacacatctacaaagaggaaactattagaatctgtaggacctcttaagcccaaagggtctactgcaggcaggatgggcgttacagaaaaaaataaaaactctcattccaaattgctcctaagatggacaaattggttacttctccagaaggtctaatcaaggttaacaaaataggtaagttcgtggagttagaatgcatcttccctggagttcagaggtatttgggatgaccaaaggagtctgctggacagtatgtgtgttttacaaaatggcccccacagtgattaaagaccagagacttatatctctgcatttgtcaagctggaacagtctttagtgaacacagcttacctcttttaaaactgctggtttctactgaaggaaacatggatgacatttagtgttctgtgactggtctggcaccctacttttgttgacaaagatgggaaggggtctaaaagtcatgtcacttataaaagaacttgggaggaacttttttcaaaagatccaaagattttggaaggagagattagagcagaactaagaccacttagaagataggtagatttcagctcaatataaggaatttttttttaatatcagtgcagttccaaatggaataagctgtttgaacatggcttagcagaagctgaatgacaacctgttagaaattctagggaattctgcactgagtacaacattggattatttctttgggctgtttccaactcaagattctgttatttcattataagcattttgaggaaggcagttggtataaaggtgaccttagtaataaaagtcagtgtgaagtctaaagaaattccacaatgaatttaaagacaagaattttagggacaaggatacagaaatttgcctagtaacttgcacacagcagatggtaaatatttattgactcaatggagtaatgttaaaaataaggtttcccatggactgtgtgagggccaggcatacttaacatcctttgtgagagagaggatggaaacggagtctactgtgaaagccacaagttttggggaaatacactcctgcaaagaagctggaggttaacaaccaaggcaaaggggccagaccacagggagatcttccaggtccaagagcactgcagggcagatgagaagcagggatgattatgttgaaagtgcaagataa

SEQ ID NO: 367422 - DNA, 404 bp, Homo sapiens
agaagtggagagtattattgaagaacactgaaaacaacctcttacgtaacaggatggagggacaagggggagcccaggtccttgtgaagtcactctggtctatagatcctttcttttgtaggttttggtgcctgggaccatatctgcaacatgagatacagagcctttcggcgaatgcaggtgcccctttatcttttcaattttgtcaagatgtcttggtctgtcttaagatatcggagtccactttctccaagtgttctgtgaatgtaggaggaatcagacaaggttcacattcagtccgaggaagtggggagaagcattcccaggagaattttcttctcattttatattttcctaccagagaggctgacaaattgtgattttctgctctgtcacttgggaaa

SEQ ID NO: 367423 - DNA, 1969 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367424 - DNA, 556 bp, Homo sapiens
agcgggcctcccgggctcgcacgtgcgggccacgcctcgcacccccttttgtttcagggcgaccccctgagtgtccatgttaaacgccaggttttattttaggaccatttaccagaaaaagagtaggtccatccgcgcgccctcggatgagcccggtgccctgtccgcccgcagctgcagtcgaggtcgggcgtccggcgtccagccgtatccgggttgacagcttcttacagtagagttagcccaggaaacgccactcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattggtggttattactttttttttttttccccgccatcagattcca

SEQ ID NO: 367425 - DNA, 2425 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 367426 - DNA, 2793 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttatcacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 367427 - DNA, 2507 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaatgtatccttgtggttgtcagataaaatttagactttttaaagcataagactttgagatgggcatggtggtatgtgcctgtagtcccagctactaaggaggctgaggtaggagtattaattgaacccaggagtgccagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatagtgataatgttgtaacattttggtgacaagtaatgcttgcttctttaatagattagattactaaaaggaagtcccttgaaattacccttgatttttcacgtgtgtaccctttgtccattccaaacctgttactgtccttaacttttggcgtagaaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367428 - DNA, 1883 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367429 - DNA, 2056 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgataaagagagttttaatgagcaaaaaacttgcagaatctgaaggaaaaggctggtatagctgtacgaagtggcagagcatgaaattgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367430 - DNA, 2212 bp, Homo sapiens
agcgggcctcccgggctcgcacgtgcgggccacgcctcgcacccccttttgtttcagggcgaccccctgagtgtccatgttaaacgccaggttttattttaggaccatttaccagaaaaagagtaggtccatccgcgcgccctcggatgagcccggtgccctgtccgcccgcagctgcagtcgaggtcgggcgtccggcgtccagccgtatccgggttgacagcttcttacagtagagttagcccaggaaacgccactcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367431 - DNA, 1915 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggatatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367432 - DNA, 2371 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatatactttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 367433 - DNA, 1861 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttatcacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagac

SEQ ID NO: 367434 - DNA, 1167 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagaggtatgttgagagattatttttggccttttaagtgtgagtgtcttggaggactttaacatttttagccaagtcaaactattttacttccagaaaaattagcctggtggtgtttttagagggatttggggttatacaacctatatgaaaatcggcctttttgtgg

SEQ ID NO: 367435 - DNA, 1992 bp, Homo sapiens
ttcaaatttgggttggggagagctaagtggtaatttttaattccttcaaattttccatgaattggactaatttaaattctggtcagagataacaaaggataatacaatttgatctatgattatcttgtgataaatacttaatggaagttaaattatttttaaaaatcacagaaggtaactcaggttacaaaaatactttgcagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttatcacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 367436 - DNA, 1225 bp, Homo sapiens
tgtatagtatatctaaatatcctgtgtaggcaggacttaagggaactttatgtagacttattttattaaaatgccattttttttgagaaattgatggtcttggctactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 367437 - DNA, 425 bp, Homo sapiens
ttttgaaagcccatgggagaagtcaaatggagagtatgctcatcagtggctatgcactcaactgtgtggtgggatcccagggtaaggtttgggatttggtttatagaatgagattgctacagattaaaactagcttttcttttggctgggcgcggtggctcatgcctgtaatcccagcactttgggaggctgagtcaggtggatcacgagggcaggagtttgagagcagcctgtccaatatggtgaaacctcatctctactaaaaaatacaaaaattagctgggcatggtggcacctgcctgtagtcccagctacttgggaggctgaggaaggagaatcactggaacctgggaggcggagattgcagtgagccaagatcacaccactgcactccagcctgggctacagagtgagactccgtctca

SEQ ID NO: 367438 - DNA, 233 bp, Homo sapiens
ttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagtttt

SEQ ID NO: 367439 - DNA, 480 bp, Homo sapiens
gttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgca

SEQ ID NO: 367440 - DNA, 424 bp, Homo sapiens
tcccttttgtgaagtcacctaattttcttcttttcctaggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggtaagcatggtttcccgctctttgttaacctctgcagaacaggttgcattaaaaaggatagtagtcaattacatgtcagcaaacataagtaacagacttgtcaaatacttaacatgaaaaacttcacagcaagcatttgttgttcagtcactgtaattcaagggataatgactaattattagcactggtgtgtcttcgttaactgtgattgctaatctctc

SEQ ID NO: 367441 - DNA, 1300 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggatacacaactgattgggtggactgactacttgcgtgactgtagcgccatacctacacgactggctgccaacccactcacatgacaggtaacctgcgacacgtacgacaccctacctgccacgccacacacgatcacgacagacgacgcctgggcatggactcgtagcaaggaccaaacgacccgaccggacgccgaggacacctacactacacgacgcgagactaactacgcccgcacgcaactaccatacacaacaactgcacgactgaccatacgtcaaaacccggacaaagcccatcgccgacaataccggacacaccacgagcgccactcgcacctgcaatgcgcaggacacagcaggacgacgacgacactcccccagacaacaacctccaagagggcaccaacgagctagaacatggagcaagcagcatagacatggagtgacaggggggcatcacgcaccgatccccgtggatcctatccacaaacaagccaactcgggcacataacaaggggatgaagcaacagtaaggctcccgccctggcgacagaacgacatgccgtgcacaccgcagacgagacacaaggacaagcacgacccacacgagccagagcccggagcccaccgcaagcagcgcggacgaacatcgaggcggaaaccgaccgcgcgacacgcgcccagggggcaccacaagtccaccaagggggcacacagccagcaccgaccgccgggagaacctatgcacagaccacacgggcagggaggggacaccccgggggagcgtcccagagcaccacgtgaagagcgcaacactgggcggaccgagcacacagcggaggaacaacaacgcgaaccgacatcgtcgcggcgcacagagcacccacagcgggcccgaaccccgcgaccacaggagtcacccgagacagacaccacgccgaggaggacaccaaccgcaggaccacga

SEQ ID NO: 367442 - DNA, 1417 bp, Homo sapiens
taagcgtttttctcccccacacttttaaacagggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367443 - DNA, 1363 bp, Homo sapiens
ctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgta

SEQ ID NO: 367444 - DNA, 1039 bp, Homo sapiens
cagagaccccatgctggttgcatagttttcaaggtatatggaaagggctgcttctacagcacccccaccgggaaccacagattttgactccaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctagcgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 367445 - DNA, 1803 bp, Homo sapiens
actttacgcaggcgcgttaggtcctagtcgctatgcgtgtgcttgtgggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367446 - DNA, 2104 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367447 - DNA, 2507 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaagaaatgaatgccctttccctctacaggagacgttgactgtttctcttaagccaaaattcagggctttacaagaaattggtatgaaatagctcccaggaaaagacagagagagggatatgtgcacttatgtatttagtggctttttatttcccatgtttctcctgcaggatgccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367448 - DNA, 2021 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtggatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367449 - DNA, 2313 bp, Homo sapiens
cgagaagggtcacgcacaggattgcgacctcgattggaacgcgcttcccgaaagggcatgcgcagagaggtcgtagtcgcgtctgaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaagaaatgaatgccctttccctctacaggagacgttgactgtttctcttaagccaaaattcagggctttacaagaaattggtatgaaatagctcccaggaaaagacagagagagggatatgtgcacttatgtatttagtggctttttatttcccatgtttctcctgcaggatgatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367450 - DNA, 1982 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367451 - DNA, 1720 bp, Homo sapiens
cgagaagggtcacgcacaggattgcgacctcgattggaacgcgcttcccgaaagggcatgcgcagagaggtcgtagtcgcgtctgaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367452 - DNA, 2491 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaagaaatgaatgccctttccctctacaggagacgttgactgtttctcttaagccaaaattcagggctttacaagaaattggtatgaaatagctcccaggaaaagacagagagagggatatgtgcacttatgtatttagtggctttttatttcccatgtttctcctgcaggatgatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367453 - DNA, 1380 bp, Homo sapiens
aaagatccttcaggtctctacttcaaaggggaagctgagccagctcggagatcatacacgccagggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367454 - DNA, 2286 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaagaaatgaatgccctttccctctacaggagacgttgactgtttctcttaagccaaaattcagggctttacaagaaattggtatgaaatagctcccaggaaaagacagagagagggatatgtgcacttatgtatttagtggctttttatttcccatgtttctcctgcaggatgatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggtgagaaacgggcctgggtatcagacagggttggaatgtcttctctgggctggggaagtgatgggattaggagagctgagattacaattacagagtgagaggatgccaccacttctagccaacctgcagatgagaaggtgtgaggtcttaaagacagccatactgctcacttctgttacagagccaagtcagcatggggagagtgaggaaggggaaacagaaaccaggaggagcagtgggctccttcaaggctgagaagacccctgtaccttccctctttcctgctctaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtc

SEQ ID NO: 367455 - DNA, 1110 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctaccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgccatacctggggtgcctggccggcagcttatcctcttccacgcgtgagcagctgctttgcgaaacgaccacatgctcgggggc

SEQ ID NO: 367456 - DNA, 1525 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtc

SEQ ID NO: 367457 - DNA, 2575 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaagaaatgaatgccctttccctctacaggagacgttgactgtttctcttaagccaaaattcagggctttacaagaaattggtatgaaatagctcccaggaaaagacagagagagggatatgtgcacttatgtatttagtggctttttatttcccatgtttctcctgcaggatgatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367458 - DNA, 2865 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaagaaatgaatgccctttccctctacaggagacgttgactgtttctcttaagccaaaattcagggctttacaagaaattggtatgaaatagctcccaggaaaagacagagagagggatatgtgcacttatgtatttagtggctttttatttcccatgtttctcctgcaggatgatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggtgagaaacgggcctgggtatcagacagggttggaatgtcttctctgggctggggaagtgatgggattaggagagctgagattacaattacagagtgagaggatgccaccacttctagccaacctgcagatgagaaggtgtgaggtcttaaagacagccatactgctcacttctgttacagagccaagtcagcatggggagagtgaggaaggggaaacagaaaccaggaggagcagtgggctccttcaaggctgagaagacccctgtaccttccctctttcctgctctaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367459 - DNA, 2189 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaagatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367460 - DNA, 2181 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctaatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367461 - DNA, 2266 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctaatggaatgaaaccttccaaaaagaggttctcggcagccgcctagagaccacccaattgctggctaaagccatcaccaaagccccacaaccccccaaggcctgggtcttagtcacaggtgtagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367462 - DNA, 2059 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctacttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagaccttcggtgctgccctgggccgccgagccttcatccctctccccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtctcactaaccttggctcatctctttggcctagattctcctgggatttacttcaaggaatgtcaccctagatgattcttccccaaagacggggttttgaaagttataatgggcagtctctctcatcaccgtttcccttcttggtccttcagttgccaaaagaacttgtcacaagtttgggacatcaggttatgataaagatagacactagaagagagaatgatgatccatttccaatgggccctgtagtcaccctggatgctgtcagagtgccattaggatgccagtagaggaagaggtaaggcccaggtgtaggatagccttcagtctgtgtcaccaaatggcaagtgcattactaaccacacagtggtcccagtttatcaggctgcagcagaacaaagtcaacatccctgtctataagaagcttaggacttgcctctcatctgactggggccactcagtcaaccagggcccttagcacaaaagggcagaagacacttttggtctactgcacacccaccatcactgaaagtgaaaatggcaagaaaccaatcaagaagtataaacaaccctatcaggaaa

SEQ ID NO: 367463 - DNA, 1441 bp, Homo sapiens
actttacgcaggcgcgttaggtcctagtcgctatgcgtgtgcttgtgggtgagggagggcagaaagggagagtgctgggcgggcttagtcggagattgaggactgggaatccgcttccgggagggcactgtctagtgcacaggcaacctggccttcgcctcctagcccgagaagccgaatctccctaatccctgtgacctgtgtcacctctgcatcgcgaggagggggataagtggggagaagtctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaagcttactaccagcccagtctgactgcggagtatgatgaagacagcccaggaggggactttgactttttctccaacctcgtaaccaaatgggaagctgcagccaggcttcctggagattctacacgccaggtggtggtgcgctcaggggttgtgctgggccgtgggggtggtgccatgggccacatgctgctgccctttcgcctgggcctggggggccccatcggctcaggccaccaattcttcccctggatacacatcggggacctggcaggaatcctgacccatgcccttgaagcaaaccacgtgcacggggtcctgaatggagtggctccatcctccgccactaatgctgagtttgcccagcgctgtggtgcaagctgtctttgggcgacagcgtgccatcatgctgctggagggccagaaggtgatcccacggcgaacactggccactggctaccagtattccttcccagagctaggggctgccttaaaggaaattgtagcctaagtaggtcatggcaagggcctgaggcctgttcctcacaggcttccaggttaggcactgtgaataggctcagctcctctagagagctgaagccatctggttcttagattcctctcccagtcctctttcccattgttctgttgctccaccttattgtctcaaggccgtaatctcatcaggttgggacattaatcttttcaactccttgtaagatttcccggtttggtttctctacatgtcctgcagctgccccacttctcctttacgctgtgtagagaatgctctgcagtttaggcaataaaaataaattgtc

SEQ ID NO: 367464 - DNA, 308 bp, Homo sapiens
atgaaaccttccaaaaagaggttctcggcagccgcctagagaccacccaattgctggctaaagccatcaccaaagccccacaaccccccaaggcctgggtcttagtcacaggtgtaggtacgccccccaaatcaccagccccttatattcgccaggggaacggggtaactcagacctctgtagctatgcacacaccagagcactggtcttttccaggcaaaatgacttcctaggcccttgatccatgcatgtttctcctaacctttgtgtactttcactaagaaattgagaccctgaaaaaacagtgg

SEQ ID NO: 367465 - DNA, 819 bp, Homo sapiens
agcggcttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattcagaaggttcagagtgtgggttgaaatccagagctcaattcataatcaccatgcaagaggcccaagatcctgatagccaatgtgctacagaagttagagaggtggagataggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtgctttctgaaattcaatctgcgaaggcacttaagaagagagaa

SEQ ID NO: 367466 - DNA, 1348 bp, Homo sapiens
agcggcttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatg

SEQ ID NO: 367467 - DNA, 1506 bp, Homo sapiens
ccctcgctgactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatg

SEQ ID NO: 367468 - DNA, 1459 bp, Homo sapiens
agcggcttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattcagaaggttcagagtgtgggttgaaatccagagctcaattcataatcaccatgcaagaggcccaagatcctgatagccaatgtgctacagaagttagagaggtggagataggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatg

SEQ ID NO: 367469 - DNA, 1325 bp, Homo sapiens
agcggcttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcatttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatg

SEQ ID NO: 367470 - DNA, 1388 bp, Homo sapiens
agcggcgtctccaagaagcaaagattcttggttctttgttgctttaagacaatttaggccaggttttccttagacaaggaaattgaaattaaaacagtagctctttttagtttttcaggcaatagagatcaaatttgggagcagtgggtgataacactgaggaatgttatctgagatgacaaattcatgactttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatg

SEQ ID NO: 367471 - DNA, 1294 bp, Homo sapiens
agcggcttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggtgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatg

SEQ ID NO: 367472 - DNA, 969 bp, Homo sapiens
cgtagtccagttactttcaggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367473 - DNA, 1037 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367474 - DNA, 958 bp, Homo sapiens
  misc_feature (883)..(883): n is a, c, g, or t
  misc_feature (899)..(899): n is a, c, g, or t
ttaggccagtagaggctggggtgaaatcggccgaggcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccgcacgggtcacaggactcccaagggatgaggccagatgggctgaacacagagtgggcctcttcagagnggcgacatcccggggnccggcatgggagcctcgaacagcgggtagagtggccggcggtaaaaaatggggcggccc

SEQ ID NO: 367475 - DNA, 613 bp, Homo sapiens
tttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggc

SEQ ID NO: 367476 - DNA, 1445 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattgtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367477 - DNA, 1300 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattgtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367478 - DNA, 1251 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367479 - DNA, 1383 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367480 - DNA, 989 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccagcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367481 - DNA, 1011 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctagagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367482 - DNA, 897 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctacagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367483 - DNA, 369 bp, Homo sapiens
tccgtgttgcgaagatgcttgtgccggagcacagccccttgggatggatacggccgctgctggaagaggggcccagctgctgtggtgcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367484 - DNA, 953 bp, Homo sapiens
  misc_feature (878)..(878): n is a, c, g, or t
  misc_feature (894)..(894): n is a, c, g, or t
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcgaaggtgaagagttgaccccatgcaccttagcttcatataaagacgcccccggggcacgggtcacaggactcccaagggatgaggccagatgggctgaacacagagtgggcctcttcagagnggcgacatcccggggnccggcatgggagcctcgaacagcgggtagagtggccggcggtaaaaaatggggcggccc

SEQ ID NO: 367485 - DNA, 684 bp, Homo sapiens
cgtagtccagttactttcaggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367486 - DNA, 1224 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccataaaagagtgcttcctttgaggctgcccaacccaagtcggcaagatacacaacacattttatttgcaaaaactcagctaagagatagtgtggagctggcaggggctggggggctgagctgaggtgggtcatgagagagcttagtcatgttggccctgggtggggcaggggtggtggggacagggagtcc

SEQ ID NO: 367487 - DNA, 961 bp, Homo sapiens
  misc_feature (886)..(886): n is a, c, g, or t
  misc_feature (902)..(902): n is a, c, g, or t
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccgcacgggtcacaggactcccaagggatgaggccagatgggctgaacacagagtgggcctcttcagagnggcgacatcccggggnccggcatgggagcctcgaacagcgggtagagtggccggcggtaaaaaatggggcggccc

SEQ ID NO: 367488 - DNA, 1438 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccataaaagagtgcttcctttgaggctgcccaacccaagtcggcaagatacacaacacattttatttgcaaaaactcagctaagagatagtgtggagctggcaggggctggggggctgagctgaggtgggtcatgagagagcttagtcatgttggccctgggtggggcaggggtggtggggacagggagtcc

SEQ ID NO: 367489 - DNA, 880 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgccctgggttaaaataaaagctttctggtgatcctgcccaccata

SEQ ID NO: 367490 - DNA, 752 bp, Homo sapiens
cgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 367491 - DNA, 438 bp, Homo sapiens
atttcattccctgtgctgagcctcctttcagtttcctcttcctacctatgtctcagctgaaaacttaagaccactcaccctacagccaatggttccaccttctgcagctgtcgtctaaattccaaatgcagccatgtcaaggcacctgcacatggcagctgtaaaagaaacactggcactttactgctgagaggaaaggtagtgccattttttgagcatcggttccctcccagagaggatgacagctggcaactctgtcctacagaaaataggaaagcaagagaaacatatacagaaatgcctacatatgatgtcactcggtagccacagccctaaaagtatcccagaaagagggcaaattagctgtaaagctaaagcaaaaaattttcctgaacagtatttggttacaaggacaaataaagttcatttatattcatt

SEQ ID NO: 367492 - DNA, 3530 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcata

SEQ ID NO: 367493 - DNA, 568 bp, Homo sapiens
  misc_feature (568)..(568): n is a, c, g, or t
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaggaacatgagggggccatctaccctgataacan

SEQ ID NO: 367494 - DNA, 475 bp, Homo sapiens
ggaatacaaaaaccacattttaccatttgtattaaacacagaaacgagctcgattttttaaaaacagatttatccattttttcaatatccctgagctgaacattaacaaatgacatgagtgaactctcatatacaatattatacattatttgtcatttttctaattaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcata

SEQ ID NO: 367495 - DNA, 4614 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367496 - DNA, 4560 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagatttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367497 - DNA, 4560 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367498 - DNA, 4838 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaatcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgtgtgtgtgatatataaaataaaaaactcctctacttgtactttggcattcaatttttagaaattcagtctcaaatgccattatggtatttttcaaatgata

SEQ ID NO: 367499 - DNA, 4558 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367500 - DNA, 4560 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaagttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367501 - DNA, 2497 bp, Homo sapiens
  misc_feature (265)..(265): n is a, c, g, or t
gtcctgtatgtgggagtagtgacaaaacagcacatggtgtgatagaatgagatggactggagggggaggtaaacataactgtgtcaagtcggtgactcatgagaacaagaggtctaacggctcctcgccaggaaatcatgagctcactaaggatgatcatgagagaggacaaggaaaggaagccaatgctgaagctgagggaattacacaaaatagtccagatacacacatgcagagattacgggaaaggtgccagccactgggngaaaaatcactttttatctgaagagaaaaaagtatattaggaaaacacacttcaagctaagaagagattggttgcaaagttttttcaaattgtaatattgaagtacacacctcctagctttgtggtatggcaagtgggttatagctaatttaaaattaacccaaaaaatgacaaaattttgtcttccagttcatcttaaaactaaattcctgaaaacaatcttgagtaccacaatttttaaaaactaattacactgacatttccagttcctgggtcctagttatcaaggctgtgtgtgtgtgtgtgtgtgtgtgtgtgtgtgtgtgtgtacaatataaaccaaatacaaccagatccattaacacttgatgaatttaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367502 - DNA, 6305 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactacacacacacttaaaatggagaaaaatgaacagtttttttggtaagattcctgcactgtggctgcaggctttggtctttcctgggtctttcgagttgaggattgttgtaattagaaatggtaaattcaaagggaggaaattatgtaaagaaaaccaatctatgtctttcctccctaaaatggggaaaaagggaacatacaaatgaagaaaatataaatgtaaatatatttgaagatttaaaaagccctgaaaggttaacctttagtgcaaatggaaagttttaatttctgctcctgggtcttacacaaacaacttacatcatgaaaaactatttccattaatgccctttttattagagcagtcactgataacactagaatatcaaagactctaacagacaagccactaaatttaacgccaataacttgaacaaagtgaagagagccaaatatgagaaagaaaactttagtctttaaataacacttgcaaccatgtggttacatgtggttgcatgtaaaccacacaaaaggatggtcttgctcaaaaaaataatggtgagtaagtaacatggaggcatttggggaattcatgtgtgcaaatgcctggcatgcagagtatggcactacagggtaaccctacacacacagccacagagaagattcctcctgtgtaacaaccgtgaaagaagagggagattactgcgttggttaagaaaggcgagatagtttttaaagctatagtaaaaattacagaacaaatagcaaatatgaagtaaaaatcaacactagataaaaaattaaagagaaatttgacttttgcaaagagaaaaggtattgcatgagactgaaagcagcagactgaataaaaaaagatagtttgaactatctttggcccataaaatcagtggccatgtttatcagtctgaatcatctttaaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtagccacattggctttctcattcttttccctatctccctctcatgctcaccctctatatgtacacacacagacgtgtatagatacacatacaactatctttcctaaaaacaagaatattcttgtacatgaccacaatacaatgatcgaaattagaaaagcaacaatgatttaaaaactagagatcttcaaatttcgctaataatcctaatcatgttctttacagatctgaataattccttaatacagggcactttgtagaatgtccttcaatttgagtttgtctaatgtttccttatgattagatttaggttatgcacttttggcaagactatcatggcatgatgttgtgtttttcttagtacaccatatcaggaggcacaagatattgatcagttctattactggttatgttaacttcaagctttggttaagatggtgtctgccaggtgtctccattgtaaagttattcattttccctttacaattaataaagatcttgtagggaagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367503 - DNA, 3960 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaaaaaaat

SEQ ID NO: 367504 - DNA, 5279 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactacacacacacttaaaatggagaaaaatgaacagtttttttggtaagattcctgcactgtggctgcaggctttggtctttcctgggtctttcgagttgaggattgttgtaattagaaatggtaaattcaaagggaggaaattatgtaaagaaaaccaatctatgtctttcctccctaaaatggggaaaaagggaacatacaaatgaagaaaatataaatgtaaatatatttgaagatttaaaaagccctgaaaggttaacctttagtgcaaatggaaagttttaatttctgctcctgggtcttacacaaacaacttacatcatgaaaaactatttccattaatgccctttttattagagcagtcactgataacactagaatatcaaagactctaacagacaagccactaaatttaacgccaataacttgaacaaagtgaagagagccaaatatgagaaagaaaactttagtctttaaataacacttgcaaccatgtggttacatgtggttgcatgtaaaccacacaaaaggatggtcttgctcaaaaaaataatggtgagtaagtaacatggaggcatttggggaattcatgtgtgcaaatgcctggcatgcagagtatggcactacagggtaaccctacacacacagccacagagaagattcctcctgtgtaacaaccgtgaaagaagagggagattactgcgttggttaagaaaggcgagatagtttttaaagctatagtaaaaattacagaacaaatagcaaatatgaagtaaaaatcaacactagataaaaaattaaagagaaatttgacttttgcaaagagaaaaggtattgcatgagactgaaagcagcagactgaataaaaaaagatagtttgaactatctttggcccataaaatcagtggccatgtttatcagtctgaatcatctttaaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtagccacattggctttctcattcttttccctatctccctctcatgctcaccctctatatgtacacacacagacgtgtatagatacacatacaactatctttcctaaaaacaagaatattcttgtacatgaccacaatacaatgatcgaaattagaaaagcaacaatgatttaaaaactagagatcttcaaatttcgctaataatcctaatcatgttctttacagaaaaagaaaatcccggatcatgtactgcattgttgccatgtcttttaagtctcctttactctgaataattccttaatacagggcactttgtagaatgtccttcaatttgagtttgtctaatgtttccttatgattagatttaggttatgcacttttggcaagactatcatggcatgatgttgtgtttttcttagtacaccatatcaggaggcacaagatattgatcagttctattactggttatgttaacttcaagctttggttaagatggtgtctgccaggtgtctccattgtaaagttattcattttccctttacaattaataaagatcttgtagggaagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcata

SEQ ID NO: 367505 - DNA, 3652 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaaggtgaatatccaggtagtaattctagaagccatatataaaagatataactaaaggaactactttgcctaaatacttcccccaatatgatgcatcaatatgaagcatttgtgaatctgctgccctgatttcttccttctctacctccaaacaggatttttttcctgctaaatggtgagggatactgctcatttcctgacagccagtacttgtaacagcaccagtcatttctaagttaatacaaatgtgtaattatacttaaagctga

SEQ ID NO: 367506 - DNA, 3469 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcata

SEQ ID NO: 367507 - DNA, 813 bp, Homo sapiens
gagaggaacgttgtgtgtggcagcaaggagcccgcagaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367508 - DNA, 706 bp, Homo sapiens
  misc_feature (59)..(59): n is a, c, g, or t
tggcatgtgaaatatcacggaaaaatccgtcaccatcggagtgtgaaaataattaattngggtattgagtgccatgtgaccgaccacattcatgctggaatggaaaccacttacaccgttctacaaaatgaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaaaaaaat

SEQ ID NO: 367509 - DNA, 2959 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccaaggcttctctttggttgagatcttccttgtacggtccgtttccagtaggtcacttgcaataggggctctggtctccattgaccgatatcttctcaagttgagccatagctgtgtcccttcactcc

SEQ ID NO: 367510 - DNA, 1135 bp, Homo sapiens
tgttttgttgttgtgtttttttttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgttttgttggtcttttgcctgttagtactggtagaatgaagcttcatgagggctttgtttctattgcctagaaaagttcctattggtggtagtctcttagtatttgttgaatgatgaaataaatggtttaaaatgttctttgttagtaaaaagagattcttattggtggtaaaaatgtgaaagaatatagtttttcagttacagtttctttttttacaaatttgctcccagtcatttcctttaatcagtctttttaccaactttgcaataagtatcacaatgctgcctcctctgtggatgactgatggcaagagtctgaattgaaagaaaaatgggttggaattagaatgaaactatttgtttttatgagtctctgataatgaaagactttcacaaaaggaaagtataacattcacacgtatacatatgtaacaaacctgcacattgtgcacatgtaccctaaaacttaaagtataatt

SEQ ID NO: 367511 - DNA, 3214 bp, Homo sapiens
  misc_feature (2822)..(2822): n is a, c, g, or t
  misc_feature (2829)..(2829): n is a, c, g, or t
  misc_feature (2832)..(2832): n is a, c, g, or t
  misc_feature (2839)..(2839): n is a, c, g, or t
  misc_feature (3011)..(3011): n is a, c, g, or t
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaagtaattctccagactctgattcccaatttcagcagtaattttaggtttccttttcagagaagtaagaattacaccaaattttagaaaaaaaaaaaaagttgcattaaacaataacaacaacaacaacaacaacaacaaaacacttcctaggaacttgtccttattcatttccgcttctctcaatttccttaagggaaaatttccatttatcttctttgatcctttggagtcttgctttcttttctactggagtgtcttctcacattcatgtgccctcatgttgtcatttatattcaaacttaactcccatgtggcacccacagaaacattnacctatnaanggactgnccccaaagaagtaggacccactaatgcagatcctgtgtgtctagctaagatgtattattctgctgtggatcccactaaagatatattcactgggcttattgggccaatgtatgcaagaaaggaagtttacatgcaaatgggagacagaaagatgtagacaaggaattctatntgtttcctacagtatttgatgagaatgagagtttactcctggaagataatattagaatgtttacaactgcacctgatcaggtggataaggaagatgaagactttcaggaatctaattgcaaaggagattcggtcgtgtggtacttattcagcgccggaaatgaggccgatgtacatggtatacttttcaggcacattctgtgg

SEQ ID NO: 367512 - DNA, 2208 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactgcactgtaagtactgcatcatccaccaatctaccaagttattttagtactgcatatgtaatgcttttaactaaacaaaatgtgaagagctttgctcattgattattttttcaataaacgattacaatagtgtcctgaa

SEQ ID NO: 367513 - DNA, 1244 bp, Homo sapiens
  misc_feature (852)..(852): n is a, c, g, or t
  misc_feature (859)..(859): n is a, c, g, or t
  misc_feature (862)..(862): n is a, c, g, or t
  misc_feature (869)..(869): n is a, c, g, or t
  misc_feature (1041)..(1041): n is a, c, g, or t
aataaaatgagggtgtgaaccatgaggatattttggggagaaggcagaggaaacagcaagtgcaaagttcccaaggcaggcacacacttgatctgctctaagaacagcaaaaggatggatggagcagggtgagcagaaggtgtggaaagctagatcacctgaggccatgataaggacttcagcattaattctgaggaaggtggagagccccagagggcactagcaaagaagtgacatgttttcttatttaccactccagggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaagtaattctccagactctgattcccaatttcagcagtaattttaggtttccttttcagagaagtaagaattacaccaaattttagaaaaaaaaaaaaagttgcattaaacaataacaacaacaacaacaacaacaacaaaacacttcctaggaacttgtccttattcatttccgcttctctcaatttccttaagggaaaatttccatttatcttctttgatcctttggagtcttgctttcttttctactggagtgtcttctcacattcatgtgccctcatgttgtcatttatattcaaacttaacaaaagttaatgcccaaattacaacccccagagcagaagtgtgcctccttcagcctcccatgtggcacccacagaaacattnacctatnaanggactgnccccaaagaagtaggacccactaatgcagatcctgtgtgtctagctaagatgtattattctgctgtggatcccactaaagatatattcactgggcttattgggccaatgtatgcaagaaaggaagtttacatgcaaatgggagacagaaagatgtagacaaggaattctatntgtttcctacagtatttgatgagaatgagagtttactcctggaagataatattagaatgtttacaactgcacctgatcaggtggataaggaagatgaagactttcaggaatctaattgcaaaggagattcggtcgtgtggtacttattcagcgccggaaatgaggccgatgtacatggtatacttttcaggcacattctgtgg

SEQ ID NO: 367514 - DNA, 817 bp, Homo sapiens
ctcggctctacctggtctccaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttagttctacagttactccaaca

SEQ ID NO: 367515 - DNA, 5269 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgttttgttggtcttttgcctgttagtactggtagaatgaagcttcatgagggctttgtttctattgcctagaaaagttcctattggtggtagtctcttagtatttgttgaatgatgaaataaatggtttaaaatgttctttgttagtaaaaagagattcttattggtggtaaaaatgtgaaagaatatagtttttcagttacagtttctttttttacaaatttgctcccagtcatttcctttaatcagtctttttaccaactttgcaataagtatcacaatgctgcctcctctgtggatgactgatggcaagagtctgaattgaaagaaaaatgggttggaattagaatgaaactatttgtttttatgagtctctgataatgaaagactttcacaaaaggaaagtataacattcacacgtatacatatgtaacaaacctgcacattgtgcacatgtaccctaaaacttaaagtataatt

SEQ ID NO: 367516 - DNA, 4570 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcacttgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367517 - DNA, 3227 bp, Homo sapiens
atcagattgattatggacttctcaaaaaccaagctttccattcaccacaaataagcgtgttgctcctagtagttcttgccagagaacacagtcaaagaagataactatcttatacattctgcatgttacataccaaggaaggataataattctctctttgttcccaggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367518 - DNA, 5215 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagctttgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccaccttaaaaaatgtatggcttctttgaggaattcttatgtcttaaagactttttacattctagacaattaaattgattgaggtcataaattaagaagtgaatagttaccactacacggtaaggtaagcagcctgaaagcatttgtatcatatatgtgtgtgtgtgtgtgtgtgtgtgtgtgtgttttgttggtcttttgcctgttagtactggtagaatgaagcttcatgagggctttgtttctattgcctagaaaagttcctattggtggtagtctcttagtatttgttgaatgatgaaataaatggtttaaaatgttctttgttagtaaaaagagattcttattggtggtaaaaatgtgaaagaatatagtttttcagttacagtttctttttttacaaatttgctcccagtcatttcctttaatcagtctttttaccaactttgcaataagtatcacaatgctgcctcctctgtggatgactgatggcaagagtctgaattgaaagaaaaatgggttggaattagaatgaaactatttgtttttatgagtctctgataatgaaagactttcacaaaaggaaagtataacattcacacgtatacatatgtaacaaacctgcacattgtgcacatgtaccctaaaacttaaagtataatt

SEQ ID NO: 367519 - DNA, 4465 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367520 - DNA, 6363 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactacacacacacttaaaatggagaaaaatgaacagtttttttggtaagattcctgcactgtggctgcaggctttggtctttcctgggtctttcgagttgaggattgttgtaattagaaatggtaaattcaaagggaggaaattatgtaaagaaaaccaatctatgtctttcctccctaaaatggggaaaaagggaacatacaaatgaagaaaatataaatgtaaatatatttgaagatttaaaaagccctgaaaggttaacctttagtgcaaatggaaagttttaatttctgctcctgggtcttacacaaacaacttacatcatgaaaaactatttccattaatgccctttttattagagcagtcactgataacactagaatatcaaagactctaacagacaagccactaaatttaacgccaataacttgaacaaagtgaagagagccaaatatgagaaagaaaactttagtctttaaataacacttgcaaccatgtggttacatgtggttgcatgtaaaccacacaaaaggatggtcttgctcaaaaaaataatggtgagtaagtaacatggaggcatttggggaattcatgtgtgcaaatgcctggcatgcagagtatggcactacagggtaaccctacacacacagccacagagaagattcctcctgtgtaacaaccgtgaaagaagagggagattactgcgttggttaagaaaggcgagatagtttttaaagctatagtaaaaattacagaacaaatagcaaatatgaagtaaaaatcaacactagataaaaaattaaagagaaatttgacttttgcaaagagaaaaggtattgcatgagactgaaagcagcagactgaataaaaaaagatagtttgaactatctttggcccataaaatcagtggccatgtttatcagtctgaatcatctttaaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtagccacattggctttctcattcttttccctatctccctctcatgctcaccctctatatgtacacacacagacgtgtatagatacacatacaactatctttcctaaaaacaagaatattcttgtacatgaccacaatacaatgatcgaaattagaaaagcaacaatgatttaaaaactagagatcttcaaatttcgctaataatcctaatcatgttctttacagaaaaagaaaatcccggatcatgtactgcattgttgccatgtcttttaagtctcctttactctgaataattccttaatacagggcactttgtagaatgtccttcaatttgagtttgtctaatgtttccttatgattagatttaggttatgcacttttggcaagactatcatggcatgatgttgtgtttttcttagtacaccatatcaggaggcacaagatattgatcagttctattactggttatgttaacttcaagctttggttaagatggtgtctgccaggtgtctccattgtaaagttattcattttccctttacaattaataaagatcttgtagggaagaaagtaatctttctttaaataaagcagcaatagaatgagagatttttaaacatataaaaagcagaaaaatataaatgaatcaggagtaaagtaacattaaaaattggaatacatttaaagaaccatctactaatttctaaccatatattatttttaataatggtcttaaaatttctttttctatagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaatgatatcaccgctgttagggttttataaaactgcatttaaaaaaagatctatgaccagatattctcctgggtgctcctcaaaggaacactattaaggttcattgaaatgttttcaatcattgccttcccattgatccttctaacatgctgttgacatcacacctaatattcagagggaatgggcaaggtatgagggaaggaaataaaaaataaaataaataaaatagaatgacacaaatttgagttttgtgaacccctgaacagatggtcttaaggacgttatctggaactggagaaaagcagagttgagagacaattctatagattaaatcctggtaaggacaaacattgccattagaagaaaagcttcaaaatagacctgtggcagatgtcacatgagtagaatttctgcccagccttaactgcattcagaggataatatcaatgaactaaacttgaactaaaaattttttaaacaaaaagttataaatgaagacacatggttgtgaatacaatgatgtatttctttattttcacatacactctagctaaaagagcaagagtacacatcaacaaaaatggaaacaaggctttggctgaaaaaaacatgcatttgacaaatcatgttaatagctagacaagaagaaagttagctttgtaaacttctacttcatttgattcagagaaacagagcatgagttttcttaaaagtaacaagaaaaggaacaaaaaaaatgaggtttgaaatcttttaccatggcaaaacattaacatctttctcaaaaacatagagaaatctggaaaaatcaagaagataaaattctggaccagttagtgacattctttcaagcatacttgtaaaatgtttccttaaagtgttcttgggatgaaaatgattgtcatgtctccaacaacagtgaactgatgttgttccttggaataaaagtcaatccccacctta

SEQ ID NO: 367521 - DNA, 3969 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagaagactggaagcatacaactttgtacatttgtgggggaaaactattaattttttgcaaatggaaagatcaacagactatataatgatacatgactgacacttgtacactaggtaataaaactgattcatacagtctaaaaaaaaaaagaaagaacaaaaaaatttttggccccccccggccccgaaaacgtttgtaaaaccactccgttataggcggcgccggggccccatgtgagtgatagttcagacgccttgggtccttaggcgtcgttcccaaggagaagaccctccgggtcataggactaagtggcgttgggatttcttccagccgaattaaaagaaccgcccggggggagacccgagcgttttttagagaagatgtccaaatggaagttcgagaggccatacggggatcctttaacgagagttccaaagagctctcatttaaattacg

SEQ ID NO: 367522 - DNA, 3991 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcgggatcctctagcacaaagaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaaaaaaat

SEQ ID NO: 367523 - DNA, 3828 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcatcttctgagactcacaggagaatatggaatgtgatctacccaatcacagtcagtgtgattattttattccaaatatctaccaaggaatgaccaggagaataagatcctccgatgttcgcaatggtgtggtgtcaggaggctgcctcttagacaatctccagatgtactgtgatgtgagtttgaaaaagagttcctgaagtaccacatctgggagacatgccactagctgagcttcccaaaagtctaccaagagctgaggaattgtatcttcgggatcctctagcacaaagaattgtatcttcatccttagcacaaagcaccttaaaaacagtaaaaggagcctctatattccagataaatatagcactgataaagcgacagctgggctgaatatcacagcatcacatgggccacgcaatcaataatttaccattagcattagcgccatggcaaaagcaaatttagacatttttaaaaggaaacagattctaggatgtacaaataaagtttctacagatatagtcttttaattagtacttttatcttataaactgattatgtatgtctgttttttcaataaacaaacaaatgaaaaaaaaaat

SEQ ID NO: 367524 - DNA, 3410 bp, Homo sapiens
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaaactggaatttgcccttctgtttctagtttttgatgagaatgaatcttggtacttagatgacaacatcaaaacatactctgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttagttctacagttactccaaca

SEQ ID NO: 367525 - DNA, 3268 bp, Homo sapiens
  misc_feature (2876)..(2876): n is a, c, g, or t
  misc_feature (2883)..(2883): n is a, c, g, or t
  misc_feature (2886)..(2886): n is a, c, g, or t
  misc_feature (2893)..(2893): n is a, c, g, or t
  misc_feature (3065)..(3065): n is a, c, g, or t
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaagtaattctccagactctgattcccaatttcagcagtaattttaggtttccttttcagagaagtaagaattacaccaaattttagaaaaaaaaaaaaagttgcattaaacaataacaacaacaacaacaacaacaacaaaacacttcctaggaacttgtccttattcatttccgcttctctcaatttccttaagggaaaatttccatttatcttctttgatcctttggagtcttgctttcttttctactggagtgtcttctcacattcatgtgccctcatgttgtcatttatattcaaacttaacaaaagttaatgcccaaattacaacccccagagcagaagtgtgcctccttcagcctcccatgtggcacccacagaaacattnacctatnaanggactgnccccaaagaagtaggacccactaatgcagatcctgtgtgtctagctaagatgtattattctgctgtggatcccactaaagatatattcactgggcttattgggccaatgtatgcaagaaaggaagtttacatgcaaatgggagacagaaagatgtagacaaggaattctatntgtttcctacagtatttgatgagaatgagagtttactcctggaagataatattagaatgtttacaactgcacctgatcaggtggataaggaagatgaagactttcaggaatctaattgcaaaggagattcggtcgtgtggtacttattcagcgccggaaatgaggccgatgtacatggtatacttttcaggcacattctgtgg

SEQ ID NO: 367526 - DNA, 1291 bp, Homo sapiens
  misc_feature (1221)..(1221): n is a, c, g, or t
  misc_feature (1235)..(1235): n is a, c, g, or t
agagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctgggaaaaatgggatgcctccancttgttcaaaaatnctaaacccatcttgaaaaaccccggtttgccaaaccctttttttcccaggttccca

SEQ ID NO: 367527 - DNA, 14331 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367528 - DNA, 771 bp, Homo sapiens
tgtgctgcgtgatttagaggatcccctcagcacacggaggatgggaaggaagcctggcaccgcggaaaggcctatgggatgagtcgctgtgggtggaaattcaggaattggtcgggggatcattgggacctttagttgcccttctttgggtacaggctgtcccggaacagggcctgagcgtcggggcgggagcctcatggaggagctgagaacacaggtgtctcgctgaccctcctctcctgcctgtctccatccccagggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacaggtgagcctatcctggtgtctgggatcgcctcctccagactcgtggggtcccctttcagtgtctctgccataggctcccaacttgggcttgcacaccactagaaacagggagctcactactcctgagtctgccccatcgatctttacacaatcttggcttggtagagcacagactgtttcctctagcacatacccgttagacccgagttctgctccttccttctagacctctgcacattgacaataggtaatcaggcctttatttatcctgtacttccaagtccaaaacacattagtacttaataataatgagcaactgtttactgagcactgactgcctttatttccagcc

SEQ ID NO: 367529 - DNA, 380 bp, Homo sapiens
ctccaaggcctcccaggaggctggcctggccctcactagcccagccccccggggtgtgatgggcagacctctggcatcaggacccccctccctccagagtcacctccgtgtcttttcactggcctatgtgccccccagaggcctgtgggcccgacgccacctgtgtgaaccggcctgacggtcgaggctacacctgccgctgccacctgggccgctcggggttgcggtgtgaggaaggtgaggggagccaggcctgagacccccagggtcctagtgtcagctggggaggctgggtggggcactctgaggccatgatgggccctacggatgataaaacgattcccaagccagaggatctcgaagtcacctggccacatgtc

SEQ ID NO: 367530 - DNA, 14844 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
  misc_feature (14844)..(14844): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgccaaaaaaaaaaaaaaaaaaaaaaaaaaaaaaaaaaaaaaaaaaaaaaaaaaaagggggggggggggggctataaaatatattcccccctcgggggggccccaaaattttagagggggtcaccgagttttttttgtgtaaaagggcggggcccctctaaaaggaggagaggggatttaataaaagaggagagaggcggaggggcgcgcggggttaaaaaaagagggggggagagagggggaaacacggtggctagatgcgggggaatctttggggggagagaggaaccctatttcttgcggggggggggggcaaacatagtggggcgaacaaaccatcccataaagagaagattttaagaggctcatggagggaaaacaatttaacactgagagggggtattagtggggggtcaaacacgaggggataattgtcctggcgggttaaaaaaagatttggataacagagagattatatttgtgaaacattttttcagggggcgtagtaataaaaatgn

SEQ ID NO: 367531 - DNA, 14382 bp, Homo sapiens
  misc_feature (1434)..(1434): n is a, c, g, or t
  misc_feature (1443)..(1443): n is a, c, g, or t
  misc_feature (5243)..(5245): n is a, c, g, or t
  misc_feature (9073)..(9073): n is a, c, g, or t
  misc_feature (9117)..(9117): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagcacagacccccccacccccgccggccgctgtggcggtcgcagtgacaccagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367532 - DNA, 14047 bp, Homo sapiens
  misc_feature (1099)..(1099): n is a, c, g, or t
  misc_feature (1108)..(1108): n is a, c, g, or t
  misc_feature (4908)..(4910): n is a, c, g, or t
  misc_feature (8738)..(8738): n is a, c, g, or t
  misc_feature (8782)..(8782): n is a, c, g, or t
ctctctgtttgggaccgtgggcgcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367533 - DNA, 12638 bp, Homo sapiens
  misc_feature (3499)..(3501): n is a, c, g, or t
  misc_feature (7329)..(7329): n is a, c, g, or t
  misc_feature (7373)..(7373): n is a, c, g, or t
actaatgggtgtgtcatgcaaagggagaatgagagcctgccgagaataaagcaggaagagcccagcagagagaggagcagcaagaagaaccaatgagagcttggaacggttccaatatgggacagggaaccagggataatgaccacagcaactccttccagccatacccagcacttaacatacacagcgcttccgacagaactttctggtgcaatggaaatgttgcgtgcctgcactcatccaataagatagctactaagcgcttcaaatgaggctagtaccatcaagaaactgaatttctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcaggtgcctgagccggcagggctgggaaccacagagaccctagcaaggatagaggagaaacggcagggcctcaccgtccttgcagcgactcttttggtcctgtccccacagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367534 - DNA, 11050 bp, Homo sapiens
  misc_feature (1911)..(1913): n is a, c, g, or t
  misc_feature (5741)..(5741): n is a, c, g, or t
  misc_feature (5785)..(5785): n is a, c, g, or t
acagggctgtcgggaggactaataagaccctgccagtggaggactccaggcgtgcctggcacagagccagcactcctattcacgctgggtcttgtcacgcccagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367535 - DNA, 13971 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcgccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367536 - DNA, 4248 bp, Homo sapiens
gagttgcgcatccttacatcatgtgatgtgcctgtagcccccttgcttgctgcattcgtagaaagctccatgaggtttggccagaagctgagcagatgccagcactatgtttcctgtaaagcctgcagaacctcatacatgtccccgcaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367537 - DNA, 14067 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367538 - DNA, 1992 bp, Homo sapiens
  misc_feature (43)..(43): n is a, c, g, or t
  misc_feature (45)..(46): n is a, c, g, or t
aactcacacccatcaaccctcaataagctaggtacgagctggntnnaatcggccgaggctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367539 - DNA, 13756 bp, Homo sapiens
  misc_feature (1383)..(1383): n is a, c, g, or t
  misc_feature (1392)..(1392): n is a, c, g, or t
  misc_feature (5192)..(5194): n is a, c, g, or t
  misc_feature (9022)..(9022): n is a, c, g, or t
  misc_feature (9066)..(9066): n is a, c, g, or t
ggccggcgagcgggcggctgcgggcggcgcggagcgggcggcgcggagcgagcgagcgagagagcggcgcgggccgggccatggggtggcgggcgccgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagtttcgagaggtgtccgaggctgtggtagacacgctggagtcggagtacttgaaaattcccggagaccaggttgtcagtgtggtgttcatcaaggagctggatggctgggtttttgtggagctcgatgtgggctcggaagggaatgcggatggtgctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccnccccctttntcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcgtgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggctagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcagttgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggtggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagnnnaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccaccncgtctcccctgccgactcaggcgagtatgtgtgtcgtgcagccngcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggcacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367540 - DNA, 1775 bp, Homo sapiens
  misc_feature (26)..(26): n is a, c, g, or t
ttaggtagaggccggtgttaatcggncgaggctggttctctggccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca

SEQ ID NO: 367541 - DNA, 1695 bp, Homo sapiens
cccagctaggcagactcgggtgggaaggcctccctccataaccccacctggaatgccctcatctcccctactctccagggcccgaggcaggcttgccacctccaggaagccctccatcatgtgtgctcagctcctctagctctcacggctgctccccacctttggcacagccctggcactgccaaaggaaaccattctgtgtacataagcaccccagcctgcctcccctgccaggcagtgagaatgctcagggcagggcctggacccaggcatctcagcagccctgggcttaattgagggcaacaaggcccaggatgggctgggtaaatgcttgacagggacaacaggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcgggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcca
